United States Patent 7,745,391 (HUMAN THROMBOSPONDIN POLYPEPTIDE) - sequence listing, part 20

SEQ ID NO: 49797 - DNA, 7454 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcatttatgactgtcaaaaa

SEQ ID NO: 49798 - DNA, 470 bp, Homo sapiens
gacagggagtcttgctctgttgcccaggctaaagtgcagaggtgcgatctcagctcactgcgacctccgtctcctgggctcaagcaatcctcctgcctcagcctcctgagtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgttta

SEQ ID NO: 49799 - DNA, 459 bp, Homo sapiens
tactctgatttatgttcatgaggtcaggagatcgcgaccgtgctggctaacagtgaaaccctgtctccactaaaaatacaaaaaattagccgggcgtggtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgttta

SEQ ID NO: 49800 - DNA, 479 bp, Homo sapiens
gaatatgagtgttaggaccactgtagtaattgggaagaaagttacattagttaaactctgttgcccaggctggtctctaactcctgggctcaagcaatcctcctgcctcagcctcctgagtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgttt

SEQ ID NO: 49801 - DNA, 403 bp, Homo sapiens
cactgaactacctggcatgagtgttatttttgtaactggatcctcactgaatcaccatgtttgacaaatagctacgaatcagaaagattgagcaactgcctaacgtcacacagttgggatgttgtggggctgggttgtagatgtttggctgtgaagcccatctctttccacccagctgcattgtctctcagaaactttccatcaccattctgagtcagctctttagaacttcaccattacagcaacctccactctcagatgaatcttccttaattatacctctggtcatgtgatatatgtggcaattgcaaagggaattcagtatcaactcctcattctagactccaggctttccagcctggcaacagagcgagactccatctcaaaaaaaagaaaaagaaag

SEQ ID NO: 49802 - DNA, 414 bp, Homo sapiens
ctcccgttttcctctgttccaggctttccctctgtcctcatcctgtcagaatagtactgcctgcccttacacacaatatataaaactctgccatcaagtcctgttgtttttaatatgtttattgatgtgaaagggatttagaataaattttctctgaataaagcctgaggtaaactttctgtcctcttctctcttcccccttcctgcatttctgctgtagtacaagcctttcctacacaaacgcatacttttaatagattggaagtggttatgtgcagaacaagtatattaatagcttttgaaaatattcttgtgctgggattacaggcaagagccaccgtgcatggccttaactgtacacttttaaaatgatacaatttatgttacttgttttttttaaagcgtaatttttct

SEQ ID NO: 49803 - DNA, 3910 bp, Homo sapiens
gataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcatctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagccgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtgatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgaggccatctgatcccatgggaagccatcagagacactgctggtgggagcaggaaggagcagtgcccctcgagcagccaggaagcctgcggatctgggaaatggctctgccttaggcgcttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggacgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctat

SEQ ID NO: 49804 - DNA, 2029 bp, Homo sapiens
ggctcggtaccccactttatgcgtggggaatgcataggcaagataggtagcgaatgctgctcagtactttggaatcagctctcagggtagcacaaaggcattccttcaccagcagaacttcagagagatgacccattcaaatcagcagccttgtttttccaaatgcacactttagaatggcttatccatccatctttacagctctgcgtgccatttgtgaaaaacaaaagctacccaacaacctgggattataaaccaggccaaagtggtgagcacccagcagccatggtctggcttcccaccggctcctcacacagctccaagccaggctgtgttgggatggaagctttggtcctgctctcataagcctccctgttcttagagtgaccccacgcttctgtgcctcggcattgcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcgcttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggacgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctat

SEQ ID NO: 49805 - DNA, 1270 bp, Homo sapiens
aaactaggctagtagagccggggttaatcggacgagggttgctggccagtgggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcgcttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggacgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctat

SEQ ID NO: 49806 - DNA, 1309 bp, Homo sapiens
aaacagacaaccccgacaaccccaaccacaccacggccaacaagtcatgtagaggcgggtgggtataggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcgcttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggacgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctat

SEQ ID NO: 49807 - DNA, 2726 bp, Homo sapiens
  misc_feature (2628)..(2628): n is a, c, g, or t
  misc_feature (2684)..(2684): n is a, c, g, or t
  misc_feature (2721)..(2721): n is a, c, g, or t
gataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcatctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagccgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtgatggctgctccactggcccctcatgtaacctcagagatctgggcaggcatcctgtacaactgccatacngaggttttggaaatcttccgctgcaactgggtcacaggacaagccacacaggaccnagcttactaaaagaagtgatgatctctcttctgggancttcg

SEQ ID NO: 49808 - DNA, 4218 bp, Homo sapiens
gataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcatctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagccgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtgatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcgcttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggacgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctat

SEQ ID NO: 49809 - DNA, 4799 bp, Homo sapiens
gataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcatctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagccgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtgatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcgcttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggacgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatgacttcaggacatatgtgtgatcctggaatacaccatattccaatttcagagttaattacaaacagattgaggtattccatcatcatcggaagcattggctgtgtgtctgactccacatggaatgctataaagtgggatacatgtggttcttcttgttccagaacttacagtccatggtagacaacactgatacaggcaaactagcaacagcaattaagtcactggttctcagacttaatactctgcctggtcctcatgcccagatattccaatttaattggtccatggtgtggcttgaacaccaggaatctttaaaactccacaagtgattctaatgggcagcaaagtttgagaatcactggacacattgatgcacttgagccatcatttctatctagttcttcctcttcctaatcttcaggttagcggggataagtttggtccaggaccaagagttggaccaaaagggaagacaggggccagaagtctagagtgctagagccgacttgaatgtactcagtctcattgcacatggcagtgaatatggattaaatataagcccatgaaaatatttggtaca

SEQ ID NO: 49810 - DNA, 3376 bp, Homo sapiens
gataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcatctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagccgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtgatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctat

SEQ ID NO: 49811 - DNA, 273 bp, Homo sapiens
ttgctgttgtaaacatcactgcagtgaacatccttgtacatgcatcttggggcatttctaagatttccttagaatcaaccccaagaaggattgacagtcaatggacatactgaattgaagatgctggatctccttggatgaactgccgtctccagaaaggaagggcatgtacatttacaagcccaggagagtgataggagagtgcccttcctcccagtttctgctccatagcacatttttaattccagattctgcaactttagtagccgtgta

SEQ ID NO: 49812 - DNA, 369 bp, Homo sapiens
gatttggaagtggaagggaaggaagctgaaggctaagttaaggtaagatcaattttaatgattagggaatatttgaggcatttgctgagagcattgcaggaggagggcagtgtggctacagaagcaaggccatgtgactgcaggagaagtccctgaagtgttgaaccaaacaagtgcttgacaatcactgtgaggcagtgatgatggatgctgaaccaaacagttgagtagaaggttgtcaagctaggagagggaagaagtgtctcctctccttatatggaagtttctgtatgttcaaaggtggcatagagagagatgtacattccatgatactccttggtcagccaagcagccattcaggaaaacttt

SEQ ID NO: 49813 - DNA, 341 bp, Homo sapiens
gcattagaaaattagaacatttacattcataatctgtttaatcttctgttgaatgcccttgtgcactctctttgccctgttttagttccctacttgctgtagattataagtgcccttaatatctccagtatctccacagagaattttgtcttcaagccttggcatcctgttttccactgtgccttcaacctgagacttcagtgatttcacaaatgctctgaacaatggagttttgaaatggttaccatttgtattagtttcctgtggctgctataacaaactaccacaagcctgggtgacttaaaccatcaggaaatctatttctctcacagttctggaag

SEQ ID NO: 49814 - DNA, 548 bp, Homo sapiens
gcaaagcaagattttgggtttgatgcaaatctaatattggaacatacaaataaattgtataagtcaatagttgccaggatgtaagtgaaaatattactttgcaaaacgacattttaaaaaacaaagcaggatctcatttctatggtttatgcaatttttaaatattgtgttttccattttctccattactttttgtgtattatgcaaataatatattattctatagagaaatgaaacctgataggtttcttagcaatcatagaacagaatatcagtccccagccccttggaaagaacactttgtagatgaagtggcaagatagatttgacatgaatcaaatgtgttttctttgagaacttaatgggcaaaaacttagagattaaaaatgtgaatattaggtcattccaggtgggtgcagtaagggccctggagtagtttatgcacatgtgttccttgcctgggagatcaggggttttacacagtccgactcatgagattgatgcccagttagacttctcttgaagactactctgcgatctaagtgctc

SEQ ID NO: 49815 - DNA, 320 bp, Homo sapiens
ctacttagaaatttagtaattgttgtacaaaaatgagagcagtctttttcacttcttgatatttccagagtccatcccttttctagatttaattcttaaataacacatagtactacttatatagttaggcaaatctaattatattcttgattaatcaataaatgaactttgctaattccagttatagtttagtatagctgattttttaagcacctgcaaatataacaagtgaaatcctgtgatacacttaagcaacccttgtaaatcaaataaattttacttataaatgtagtaaatcaccatcctgtttcaaaagactt

SEQ ID NO: 49816 - DNA, 419 bp, Homo sapiens
gaattgtctaactagaaatttgtgttgatttggatcaggagtggttcctgcgttttaaatttgagatgttcttaccagtattttgaggactcagaacggttaatgtctatagtttataactaatcattaaaatagggcgacaaaggctgggcacagtggttcatgcctgtaatcccaccactttgggaggctgaggcaggaggattacttgagctcaggagttcaagacccagcctgggcagtatagtgagacctcattgctacaaaaattgtaaaaaattagccaagtgtggcggcacccacctgtagtcccagccacttgggaggctgagatgggaggattgcttgagcccaggaagtggacgttgcagtgagctgagatcacgccactgcggtccagtgtagtgagactctgtctc

SEQ ID NO: 49817 - DNA, 329 bp, Homo sapiens
ataatcaccaccattcccagtaatatattcactgccaggcagcttggagtaatggagacattggaagaaaaataggcgaagttattgttagcagaactgcctcttactcaaggccactatctgaagtttggaagtggtcttttctccttcctgatgagaacaatacatgtacatttttctccacgaaaaaaagattttgaccagcccaggcaacatagacctcttctctacaaaagtaaaaaaaaaaaatagccaggtttactggtgcatgcctgtggtcttagctactcaggaggctgaggtgagagtatcacttaaggccaggagtt

SEQ ID NO: 49818 - DNA, 552 bp, Homo sapiens
  misc_feature (534)..(534): n is a, c, g, or t
  misc_feature (550)..(550): n is a, c, g, or t
gtcagaatgagatacatcaaaaaacaaattgttcacaaacctccaaagatccttgaaattcctccaggtttataataaacaccatgttaaagaaactgcaacaagcaaggagggtaagggtgatgaaggaagagacaaaggacacgagtggagggagcaagtgattagaacagctcgctcacaccacaggggccccacctcaactctctaaatcccgggtattgttagacaatcacgtatattatgcccagtcctcacaaaaacttctcagggcaagtattactctttttgttttctcatggtagaaaacacagctcagagaagttaagtaatttgcaaaagttgcacagctaataagcaacaaagcccagtgtttggtctgccttattatgctgcctttctcctattgtgtatatgatatagaaataaattactttatcctgttgtgtacacaggatacagaaaaattttcatccagctgtgagccaccacacccggccccctatagtgcttaatctaccaaggtgaactctnacccagaaaaaaaacnaa

SEQ ID NO: 49819 - DNA, 752 bp, Homo sapiens
tgcactccagtctgggtgatagggcgagactccatctcagaaacaaacaaacaaaaacaaataaaaagaagttttggtaacttttctgttttgtgtgtctttaagtcgtggtgtttatataatcgacacccatttatttcagtaattcagcaagccttttagagcagtgtctcaacttcagcactgttgacactttggataattatctttattgtgggggactgtcctgtacattgtagaatagccagcaccttgtcctctacccactagatgtcagtaacttccccttgtttgtgacaacagtgtgttcagacattgctaaatattccctggggagcaaaattgtcctcagttgagagccattgtttaagagcttactctgtgccagcctggtggataggtactgaagatagaaaaattcaaggaattaatgcagtgagggcagaacgggcttataaacacataattggaaatctgtaagataagtgtaccagaaaatagcaatcaagacacctcaaaggcttgggctggtgagctatctcagaatatctcaggagcatttagtagacagctatgcttagaacatgaaatgatagaatgggtattggtaggaaataaaagcagaaaagacaactttattttacataaccattaatgataagctcactgttagtcttgcagtttattttactgtgtggtagtgctttaagtttgatcctttctatgtcatttttttttaaatggcaaaactg

SEQ ID NO: 49820 - DNA, 655 bp, Homo sapiens
ttaccccccaggtgatggtggcaggaggtgaagcctttgggaagtgatgaggtcgtgaaggtggagcctcatgtgtgggattagtgcccttacaaaagtgactctggtcaggcgcggtggctcatgcctgtaatcccagcactttgggaggccaaggtgggtggatcgcttgaggccaggactttgagaccagcctgggcagcatggcgaaaccctgtctctacgaaaaagaaaaagaaagaaagaaaaggaacatcaacttaatgaaatatttggcatctcaaacaatgttctcgtagaccatgataaaaaaaaataagaaaaaatatattcttgcatcaaaaatttctgtaatgctacctatttttccccttggtgtgtatgaaaatgtctttactagatttagtacctccctgtcagcttccataactaacatggttatttttctacaagtcaacaaacatgtcatgtattggatgaaaaataaaattaatgacaacagttccttgagaggagaccaagttgccattatcattattgtgttatagtaatgattgttatcaacagttccatttattgataacaaacaacatgactagtggatacaatgagtataaaattcaataaactatatttctaaaaattaaaaattata

SEQ ID NO: 49821 - DNA, 934 bp, Homo sapiens
actggacaattttatggcatttctctacagtaaaatttaaactatacatgtttttgcctgtaagcttgaaaacatttggctgtgagcttgtgttcttttatcacattcgtaagtaatagaggacgtttgtaggactgcccagtagagtttattagtttatagaaattttgttttaagcaattatctcaactgttttctcaattttatctgatcatatacatgctttatcactgatatacagctacctgtttctattttcatttcagatgttttcttgtctattatcacactttctatcttaaaactttatatactatagtagcctaacataaaagtctaagaaggcttttctcaaaagttgcctgactacttttctcctggatatgtctggttttccacgcattttagctctcaccattccaatttatttttccttccctatgtgtacagacatattggagttagggggtcctaagtctttcagtattgcagtctgcatttgagagaccaaaaagtttaattctctgtaagcagttcttctgtgcttttctgtcaactaggaatctctctcaagctttatatcactctttgcccatccattaccacttacaggaataaggaaatttaactgaaatatggtgaataggcagtctaccaaatttccagagatcttagtctagaaatggtcagtttaccagttttcaggtaggcttataagtaaaatccacagctttcaaatttaaaacgttctcttaaatacattaaattatctctggattacttacaatacctaataccatgtaagtgctatataaatggttgttaagctgtactgagttttgcactatattttctattctccaccgccccacccccccatttttttttttgcccaggctggggtgcagtggcgcaatctcgactcactgtctcc

SEQ ID NO: 49822 - DNA, 570 bp, Homo sapiens
atataattccataaagagctgtgtctgaagaaatcctctgataattcagaaatttttaaaatcaataggcatggtacagacatgcagaaaatcataattagggttttaatgttgcaagactacagaagatttgcttcattattaaccaaaaaagggttacacaatgatgagcacatttggttgaattgagaaatataaatgaatctatgtttggggcattttacacttctgccaaagaatttatcggcacaatctttcagccaacactgaactaataacatttgatttacatccaaaagccaaaatacattcccaaaagccagccaaatacaaagcttcagacttcactaaaggtccacagtgaatgctgaaacgtccaagctcaggaccggctataaactcggcagtactacattaaccatgtgcaaaccaaacaacagcctcctaaggagacaactattaaatatttccagaaggggttacggatagtagagtcaacatttagaataagatcagatagacatccatttcctttaaaagacagggtctcactctgttgcccaggctgga

SEQ ID NO: 49823 - DNA, 608 bp, Homo sapiens
gatggagaaagactgcagagattcaaacccaggcctgctgacatgcagagccaatgagaatatattatcttgcagtgcagtttatgggatatatgtgtccctttgggaattcctgggtgtctgctggtggcctgttaacttggttcttgaatatgcactttgcttataactgtgcagtttgaaaagtgactcatccccaaactaggcagggttgagtgtctgtcctgtttatcttccacatgccacctgcactaacttctgaagataatctataataaaagcactgtgattaaaaaacagaaaaacacacaccaaaaatgtataggtttgtctgttggtgcttctgacaagaaaataaactcatgaatctcattaactttaaaaaaatcacatctacttaaggtttaatgactaaagccaactttctaacatatctgtaccgttctctgaacatactgttttcacacttaactacgatgttgtcacttgtttctgtctgattctgcaagggcagagaccttgaaatattcaaatctggattcccccatggtttgacccagctgaagtcaggcagtgttcgctgaaagaaataaaggtgtttccataat

SEQ ID NO: 49824 - DNA, 283 bp, Homo sapiens
gatagagaaggaggggaatcactccagatcctgctgtgaaggttgctgctgtaggcaagagacgctggcctcctgggactctaaggagcactcagagagcccacagagtctgtggcaaagaagaactcacaacttccttcacccatgtcgggttgccaagaaagctcccatggcctcttttgctggcagcttagagactggttcccattgtttttcaccccacacacacctgctgatcatcagtggtatcaaacaacactggctacttggccttgggctaatg

SEQ ID NO: 49825 - DNA, 781 bp, Homo sapiens
ctagttcagatagcattatcacatgtctatatcaaaatcacaaatagtatagaagatctcttagacttttgtattttaagaacattctgaaaaatcataaaatatctgttctgtcacttttaccattggctctcaaaataacccatgagtagttttggaacagtctcctgaggcatgaacacttctctgaacacactgttaaaaatatattcatttggaccaggaaagaaaactgaagttaaaatttcacaagtgagcccttcatttttttttccttcccctttatcttttcctgttatttggggggttttgaattacataggtggcttgaaaacaaaggcaattcttgatggagatgtttgatatgggaatgtgaaagaaaattggttgcaatagtgtttctaacactgacagtgctgtacgaagcttattttagaactaaaaggcactttaaatactgtgtattctaattactgagattgtaactggtcagtagtttcaaagattgtagtgaatgagcctcaactggaaatttataaaagcattctttctagtgtatcattttgcctgtctaaataattgactaattgactcttaactgtgaagtgcactatagaatgaaagattaggagttcctaagctttttaggtgtgacttttatcacttaactcctaggttatttcttttaacctataaaatgaggatctgagtaattttctttattctttgttctgttttgttttgtttttttttgtttgttttttgttttgtttgtttttgt

SEQ ID NO: 49826 - DNA, 366 bp, Homo sapiens
aacaaagtgctaacttaagcttttatttaaagcaaatcacaatcaccttgtttttgtttttcattttttaatttatataatttaatttttgtttgtttttcattttttatatatatatattttaaagacagagtctctctctgtcacccaggctgggttcagtggcgcagtcataactcactgcagccttcaactcctaggctcaagtgatcctcctgcctcagcctcttgagtagctgggactacaggtgtgtgccaccatgcctggcttgttttttaattttatttgtagagacgaggtcttgctgtgttgcccaagctgatctgaaactcctgggctcaagtgatcttcctgactccatcttg

SEQ ID NO: 49827 - DNA, 452 bp, Homo sapiens
ggttcacttctcagttcccctttcttcagcagttcactgggttgccttaggaaaagccacatcacctggcagcccacttgctgagtcatctgtcagattgtctcagaatggttatttgtcacttttgacatggggggaggaaaaacaagttggctaagtcactgagcctgtgaggaactgcaaaaatgaaagagaatttactctgaagcttctgagatgacaagaaatgatggctggatgcagggcagggcaggcaggaggacagaaaagcctgccgtgtgctggagactgtaaacaataggagaaacacagcctctcagtggaggcagagatcaggtcagccccacctcccttgcaacaagatcaggaattccgggccctcttgctccagcagtagtgacagcctccataaaaatgacttacctggagggaagaaaagggtgatggattta

SEQ ID NO: 49828 - DNA, 927 bp, Homo sapiens
aagattattagctgtttcttcacatagccctttcacagtgctttccatataaaaaatactccatttatactaggcagcttaggtattataaaaaatacgagctttggaatctcagctctgccatttatttggtctatggcaaattctttagacttaggatttgtttaaaatgggggttattaacattttcctcacaaataagagggattaaaatgaggaaaatacgtaaacattccaacagagtaagtactcagtgtcttttcttcccttctttgatttgattgtttcacacccttaaaaattgttattacagcattggttcttaaccctagctgcacattagaatcatccagagatatttgaataaaacacgaatggctcagccccaccccacatcagttgaatcagtctttgagggtgaggcccaagcatctggagttttgtttgtttttaagcttcccaggtaattctgataccgcataggtattgagaaccactagtctagagggaaagacttcacacataacctttcaagaaagctttcctgaggtatttctaataactttcaaagttaaaaataaggatgggggagggccagtgggatcactttaacctattactcttacctagcttttttttttttgaaacagtctcaagctggagtgcaatggcgccatcataactcactgtagcctccatctcctgggttcaagcagtcctcctacttcagcctcccaagtagggactacaggcgtccaccaccacacctgattttttaaatttttagtagagacgaggtctcactatgttactaggctggtcttgaacccctgagctcaagtgatctcctgccttgggctcccaaagtactgggattatatgcataagccacagcgcccagcctgtcgctttcttttctttcttctt

SEQ ID NO: 49829 - DNA, 676 bp, Homo sapiens
gctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaa

SEQ ID NO: 49830 - DNA, 359 bp, Homo sapiens
ctaatgctgtactttcgaagatgatgttgaaaagcctgaagcctcaagataaatgtggagagttctcctactgttcctgttttctttgttctgttttgcttttgtaagcatatgcttgtcagttagggctgaaaccaaacaaaacagctgctaaatatggttctaaaagaaataacattttggtcttcttaaggcccgtaagtttagagtaagcacagtcgtttggcagatgtcaatagggaatccgggggtagcagtcattctgggagcactatcagccatccgtattctgttgggtgtattttaccctgccagaggactggtggcctcaagtaaaagattctgtcacagaacggctg

SEQ ID NO: 49831 - DNA, 382 bp, Homo sapiens
cctcccgggttcacgccattcttctgcctcagcctcccgaaattttttgtatttttagtagagatggggttttactatgttagccaggatggtctcgatctcttgaccttgtgatctacccgccttggcctcccaaagtgaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctcccgagtctacgaacgtttataaacgacagcacctgtaccacgtattcatacctagcatgctcgtctctcag

SEQ ID NO: 49832 - DNA, 452 bp, Homo sapiens
cctcccgggttcacgccattcttctgcctcagcctcccgaaattttttgtatttttagtagagatggggttttactatgttagccaggatggtctcgatctcttgaccttgtgatctacccgccttggcctcccaaagtgaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataactattaaatattagatcaagtttctcatgtttatcttaacgtataacgatttatcttaaagcactgattttcacaaaataacatcagtgtgaaattggaaaagaa

SEQ ID NO: 49833 - DNA, 443 bp, Homo sapiens
gtagctgggactacaggcgcccaccgccacgcccggctaattttttgtatttttagtagagatggggttttactatgttagccaggatggtctcgatctcttgaccttgtgatctacccgccttggcctcccaaagtgaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataactattaaatattagatcaagtttctcatgtttatcttaacgtataacgatttatcttaaagcactgattttcacaaaataacatcagtgtgaaattgg

SEQ ID NO: 49834 - DNA, 347 bp, Homo sapiens
ctcctccaccttcacctcttagaggcctcctggagatgtggcgctctgggttgcttttgataagtaccaattctaaatgctgcagtcgctttttcttccttctctgctgccatagagccacatcttcctgagccacgtgtggctcttgggttcattttcttttcattttttccaccatggtgttctgaatggacaagtcagaattcagaggttggtattaagacctatcttcataacaagcccacttcatcggaccataggccacctgctatttgtactaacacttggggtcatttcatgtgtgaggaataatgaagttgcactgtatattcagaactttaatattt

SEQ ID NO: 49835 - DNA, 695 bp, Homo sapiens
ggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcggtgagtgccagcccaggcccttcctctccccactcttctgcaggccctctaggactctggtaagtgagcagtatccttgttctcagctgaacattggggcatgaacactgaggtgggcactgagtttgcctactttcttggaagctctccgactcttgaagggccctggatctgctttggagatggatgggcacggagcatttgtgacccccagtgctctccctggcatgttgggcttattgtgttgggagcagcttcttcgccccagcggcctccactctttaatggggaccttgcttgtgaactgcctttttcccccaagccctgggctctgtagcccccttggcaggcgggcttgggtgggggcaaggggagatctgtgtctgcccggaagggcattgtgtagagcatggggttgtgggtgacattggc

SEQ ID NO: 49836 - DNA, 364 bp, Homo sapiens
tgtagaagtagaatggatgggtcatataataactctgttaaaattttttgaggatctgccacattgtttcccaaagcagctatgccaagcttgtccgacctgtgacttgctggctgcatatggcccaggatggctttgattgcggcccagcacaaattcacaaactttcttaaaacattatgagattttttttttttaaaaaaaagctcatcagctatcgttagcattagtgtattttatgtgcagcgtgataattcttcttccgatgtgcccagggaagccaaaagattggacacccctgaactacatcattttacattccatcaacaatgtatggaaggttgcagtttcttcacatcctctc

SEQ ID NO: 49837 - DNA, 225 bp, Homo sapiens
tggctcccattttgcatatggtaattacccagattgtccaggtaggaagagtttgagcctggctttggacccatgaaggtcaacgccttacccacctgctttgtggctatagctatagtggagagtgagtcaggagaatcccttgaacccaggaggcagaggttgcagtgagccaagattgtgccactgcattccagcctgggcaacagagcgagactctatctc

SEQ ID NO: 49838 - DNA, 325 bp, Homo sapiens
agaggtttaattggctcacagttctgcaggctgtataggaagcatggtactggcatcagcccggcttctggggaggcctcagggagcttttacccatggcagaaaacaaacaggaagcaggcaagtcacaggcgaaaacaggcacaagagcacttgtggggcaggggccacacttttaaacatccagatcccatgagaacttactcagtatcaccgggacagaaccaagccatgagggacctgccccatgacccaaacacccctcaccaggccccacctccaatactgggaattacaattcaacatgagatttgatggggacaca

SEQ ID NO: 49839 - DNA, 507 bp, Homo sapiens
gggtaaggattatataattacaagcatcagtcatgtttttaattgcacggttgttagaggaaagggcaatgatttgagtttatagaaacagaattttattgttctattggtaatacttctcttctgaggcctgataattgctgtatctttctcactaagttactttaaaaagttctgcatatatgaaattgtggcaaatgcataaactgtgccttattgatttttgttgacattttacatgtttcttacgcatttttaccctccatttggaaactgtcagcttggcacatggtgctggataataagagcaaatgaagtgaatacagcaatcttcttgactattaaaaacagaattagcccaggctccgcttggtttcaaatctatctccaatagatgatttgccttttcctcccttgtagtttcaagataagaagtggaaaaataaaaatctcttagtgttatttcctctgttaataatgccagggatgatgaaaatgcttctgaag

SEQ ID NO: 49840 - DNA, 680 bp, Homo sapiens
atacatacgtgtatatgtgtgagtgtgtgtatatataaaattaaaaggtgaatgaggtaaatatatgaaggggaaattcagccttgaacttcccttgggtcacagagatggatcctctgagctgtggggtgttagtgagtgtgtatgcgtaagcatgtctgcatctgcctggtctgtctgggtcagagtatgtccatgaactttacgagcgttcagttcaataccactcagtgcagaatccgcgttcctgttttacagcccagcagccgccagccggcccatctgttaaaacataacatgtacacttcagtccgaccactggggtggagcctgggtagggggcaactcttagcagaaacaacatgctacaaacaaagcctgcctctcaagttctattttcattcaatatttggcctgaacttgaagttttggtgagggagaaggaagtgtttgtctctagaaatggcaaactgcattttgtgaaataattatagccacggcttggggagggggagcttgtaggagagaaaaaaaaatccctccagaaatgtggtgcttgtcacatcaccatgcaacacgggtttacagctttgcagtatggcatgtatatcagaaactgtttgcttttgcttgttaaaataatgcattaaaactgaatcattttgcaccaaaaaaaaaaa

SEQ ID NO: 49841 - DNA, 267 bp, Homo sapiens
ctgtggcccttggtctctgtttcctcagtccactgcagagtgtgctacaggttgtgggtactccatttgttgcagtcactgaatgcattgaacacaaattcaggtttattttctcattatcgaatgctgtggcctgcaagcagtgacccaaagcactcaaaggctgaaagtcgacggtggctcacaaaacaaacacacatataaagtcatcatcacacggccctaaagaatgtacttcccactgctgactggggctgctttgggctt

SEQ ID NO: 49842 - DNA, 267 bp, Homo sapiens
gcacaggagacatataactctcaagaaaacaccattcgagagaaagccagaagcccacaccaacattttgcattcaagactgtggggcttatggaaggccagtggacagagccctcccaaacatcgagagcctgctggatcgtaaatatcagttgcacccaagtttctgcaaaagtcagagggcaagaggtgttgcagggaagggcccaggttaaacaaaggctgcacattgtgggtgatggacactccacaaccaagctcaagaca

SEQ ID NO: 49843 - DNA, 834 bp, Homo sapiens
ggcagagataaacactgattcgtaattacctcctcccctccttccatatctaagtcatttcatagggtaatgtcaagggccacataaataagtaaagtactaagttagttttaataaaatgcatccagaattcccaagcaaaagaaaggaagggaagtcttagctaatgaggtcagtgtttctgtggacatcggtagcatatgtgttcagggcctactgttccaaaatggaagtacagagaagagtacaccagatgtctatctgcttccagggaaaacctgaaccatgaggagaattgggttggtttgctataatttggtcaccattgtttaataatctggatgtctaaatgtcttgcgattttaatttttgaacattcactaacatctaaataagagtagagatctcgatcctcttctcagttcagcttctgaatcacctggcaccatcatttaactttactgagcctctataaaattaagatacaataatgccctatttctactctccacttgatagtgatattcccagtactcaggcaagaacatgttaattaataagagctctttgaatttctttgaagctgctgagatgtctgaggtggcatgacaacacatggcaggattaatatcatttgcacttattttggtatttatattaaatataatgcagtatttaaattcgcagacaagtcagctccccattatctatgttttaatatttatttgtgtccactttcgaggtgaaactgactgtattcagcatttcagcccgtgtttaaggtggcttgtccctgaaaggtggagtgttggggattcatgcaaacatttgagg

SEQ ID NO: 49844 - DNA, 192 bp, Homo sapiens
ctaagaaataacactgaaatttcttctatgggcctggttagcaattttgtaatatttcttgtgtttgtgagtgactttctctttaaaaacaaagtcttatctgagtgttttgatttcccagtaactacaaagtttttgtaagacagttttgagttattttccctcaaatgcaatattgtgttgcatatattt

SEQ ID NO: 49845 - DNA, 335 bp, Homo sapiens
ccatgagctgtgatgacgccactgcactccagcctaggcaacagagtgagatcccatctcaaacaaacaaacaaacaaacaaaaaagagagataggaagcttaagtgatgtgtcctgtgtcacacagctaagaagtcacgtagagatcatctatctggctccaaaatattcaataagtatttgttgagcacctactatgtacttggtactatttttgggtctggaatacattcgtgaaccaaacaaactgtcctgccctcaaagagctcatattctagtttggaggcacacagtgacaaagatgagcaggagatgtgtgtcaggcagtgagaagt

SEQ ID NO: 49846 - DNA, 336 bp, Homo sapiens
gaataataattaataataatacctatgagtatgagtgtcatgttattttaaaattcaataaagatctaaaagcaattgttaggtaagcattgtccagttatgtaggataatgctaaaaaatagttactgtatattttcatgaccacgtttgccaaagtactccaaggactctcttgcaagagaaaataacagatgccatccaggtattatagctggaaactctactgctatgaattctgatagcacattcaaataatgaatttgtaagtggaaacaaaacagactgagtattgtaattgattttttgaggcaacttcaacatttcttgcaataatt

SEQ ID NO: 49847 - DNA, 289 bp, Homo sapiens
gtttcttcattggaaaaaatgtaaataggctccttggcctttgaaaatgatgtgtacagttcagaaattgtaattttagtatctcagtcttctattaactaggaagagttaatcagaaagcctagtaataaagtgagttcacaagagtccccaaatcccaaaacatttgaaaaatacaagtgtgagcttgctcctcttctcttcatatccaaatctctaatcaatcttttcctcctatgtcagaagcatcctctctcctttccaaagccaatgctcttattcatgatct

SEQ ID NO: 49848 - DNA, 180 bp, Homo sapiens
ctcaaccccagagctactataactctacacacacctgtgctcccattctcagctacctggttgctacacaaacctccttactcttactaacatggcagtgggaatgtctgccccctgagcaccagtgccattgctgccctagataacagagccacaggccctccacacatgatcatgctt

SEQ ID NO: 49849 - DNA, 390 bp, Homo sapiens
  misc_feature (16)..(16): n is a, c, g, or t
  misc_feature (62)..(62): n is a, c, g, or t
tcacagatgggaaagncattgggtggagggtcaagtggggaaacccgggactggtcccctgnaagcctcccaggagtgaaagcttacactcagctcattggcttctcgcccccagaagcctccccctgaatccccccggctgggctgcactccagcctgggtgacagagtgagaccctgtctcaaaacaaaacaaaacaaaacaaaacaaaaaaacactctgtgccaagcgctgcctaccctggtgcatgggactgcaggagaggctgtctggtaaacgtgtcaagggtaatccctgccttccaggctcttccactctgcagtggagcagatgctgaacaagcaaacttggaaccatggggcagtgatcagggacagagtctccagaaaa

SEQ ID NO: 49850 - DNA, 381 bp, Homo sapiens
tacccaccccagtgtgtgccaccctcaggagcccctggcaggaccaagactcagggtcctcattgtgggcctctgcagcttgtggaagccaccatataaagaagtccaggctatactcctagaggccacatgcaagagaactgaggcatcccagctgacagccagcaccaactgccgggcatgtgagtgaactttcctagaatacgaccctccagctcccatcaatcaagactgaagatgatatagccctggacagtgcggcttgactgcagcctcatgagacacccagagtcagaccacccagctaagctgctcctggatttctgaccctcagaaactatgatacaataaatatttgttgcaagccactaagtttggggg

SEQ ID NO: 49851 - DNA, 1268 bp, Homo sapiens
tgggctctgctggcagaaagggggtccatcctaggcatgggtactgacacaggtgacagcatctgcataccagccagcttctgtggtgtttatggcctctggaccacaggttcccgcctcagctacactggaattgcctctgccatcaaggggaaaaaaatcggtgaccacggtggctggccccatggcccaggacgtggagagcctggcgctgtgcctgcaagccctgctgagtgaagacatgtaccgactggaccccactgtgctccagatgccctttagggaggaggtgaagaccccctttcccaccccaggctgcagtgagtgagaagcccacatgctcagtccagtttgtttccttcccctgctggacaccagctgctttggcttcttggctatctggagccatagcttcccccctctaggatccccaaactagccagcatcttgaagagattcgtggagtggggacacccaagaaactgtgggaacagcacacagcagtggaggaatatgagcaagagttcatagccaagtggaggtccctggacctggatgtgctgctggtgccagttctgggctctgccttctatataggctcttcctccctagcatcagaaagtcagtcttatgtgaccctgtacaacctcctggactttcccgcgggcgtggtgcctgtcactatcgtgacactacaggacgaggaggaactggccttctacaaggggtgctacggagatagttctgacaaaaatttctcagaggcggtaagaggatccgtcggagttctggtgactgtgcagtgcattgctttgccatgggaagaggagctgtgtctccggttcatgaaggaggtggacaccttggtcaagaatcagagggggcccaagtgataggctcctggaatggagtaacagctcatgaaacacggggctggttgtggtggctcatacttgtaatcccagcagttcaggaggcagaggctggcagatcgcttgaggccacgagtttgagaccaacctgggcaacatagtgagaccctgcttctaaagcattttcttggtgttactcctgtagatcctcacccaagtgtgctcctgatgccccttccttctcatgaataccatgtccaccttatgtctcctccttctggaaccccaccaggttccttttctttgttggtccctctgtgtgggtgctcaatattcctcagatgggcccaggatggggagcagggtgaggagctcaataaacattttctgactggc

SEQ ID NO: 49852 - DNA, 629 bp, Homo sapiens
tgggctctgctggcagaaagggggtccatcctaggcatgggtactgacacaggtgacagcatctgcataccagccagcttctgtggtgtttatggcctctggaccacaggttcccgcctcagctacactggaattgcctctgccatcaaggggaaaaaaatcggtgaccacggtggctggccccatggcccaggacgtggagagcctggcgctgtgcctgcaagccctgctgagtgaagacatgtaccgactggaccccactgtgctccagatgccctttagggaggaggtgaagaccccctttcccaccccaggctgcagtgagtgagaagcccacatgctcagtccagtttgtttccttcccctgctggacaccagctgctttggcttcttggctatctggagccatagcttgtaagtgcccccaaagagggcctccagtgccatatacccaacccatgcagttagaatactcagcaagtgtggttgagagggtgtggcatccagttaagctgggtttttaaccctctaggtaaccctggccaagtcacatctcttctttcagccttagcctccccatcaatacaataaagaggttaggctgggagattactccacacccttctgtc

SEQ ID NO: 49853 - DNA, 1057 bp, Homo sapiens
tgggctctgctggcagaaagggggtccatcctaggcatgggtactgacacaggtgacagcatctgcataccagccagcttctgtggtgtttatggcctctggaccacaggttcccgcctcagctacactggaattgcctctgccatcaaggggaaaaaaatcggtgaccacggtggctggccccatggcccaggacgtggagagcctggcgctgtgcctgcaagccctgctgagtgaagacatgtaccgactggaccccactgtgctccagatgccctttagggaggaggtgaagaccccctttcccaccccaggctgcagtgagtgagaagcccacatgctcagtccagtttgtttccttcccctgctggacaccagctgctttggcttcttggctatctggagccatagcttcccccctctaggatccccaaactagccagcatcttgaagagattcgtggagtggggacacccaagaaactgtgggaacagcacacagcagtggaggaatatgagcaagagttcatagccaagtggaggtccctggacctggatgtgctgctggtgccagttctgggctctgccttctatataggctcttcctccctagcatcagaaagtcagtcttatgtgaccctgtacaacctcctggactttcccgcgggcgtggtgcctgtcactatcgtgacactacaggacgaggaggaactggccttctacaaggggtgctacggagatagttctgacaaaaatttctcagagccaccatataaagaagtccaggctatactcctagaggccacatgcaagagaactgaggcatcccagctgacagccagcaccaactgccgggcatgtgagtgaactttcctagaatacgaccctccagctcccatcaatcaagactgaagatgatatagccctggacagtgcggcttgactgcagcctcatgagacacccagagtcagaccacccagctaagctgctcctggatttctgaccctcagaaactatgatacaataaatatttgttgcaagccactaagtttggggg

SEQ ID NO: 49854 - DNA, 284 bp, Homo sapiens
catacgcagaaatggttaaattctgacttggaattccatgggaattagcaggctgtagacgaggttctggccgagaatgtcatggttggaccaagacttcccatggggctgctgtttgtggccagtttcttgtttttatttatccaatgtgtacatatgcccagaagctatttgtaatgggagtgttttaagaaattcataaatttaaaacactccacacatacaaaactctttctgaaatgtgacatcttaaaattattttctcaaagtgacataaaataaaa

SEQ ID NO: 49855 - DNA, 720 bp, Homo sapiens
ctaaagcgttttaaaaaatagtgatctcttaagtggtttagtcttagaattgaagagtattcatatctagaatttatttttgtttttttgtagttaaaagcaggtatttttgcagaaatgacatacccttactgtattccttaaataaccacatggttcggcataactaaaagatgttgaaaactacgaaagcaaagaaagttaatagtttatacccttagattatcatattattattctgtaattgctttgtataaactgatttttttttaacttaaaaagtcttacatcttctaagagcaagcttagggctaagttacatttattaacagcccagttgattgacttgactttttgccagttctagaacctcatttaattctaagacagtggaaaactgggttatatctcctcttggataacttttgtggaatttatttataatttcaacttctattttaattaagaacataagctacatgaggccaaacattttgtccatcttgttcactatatctagcacctagaatggtgcttggcacattactttgcttaaatttgttaaatgaatgagggaagtaaatattgcagtatttttctacctgttatgtaaatctgtagtttttttgaggaatattttaattttactttttatttctaattttttcaaatgttttaatagtttatatttctcctgccaagggttatggctgccccctt

SEQ ID NO: 49856 - DNA, 440 bp, Homo sapiens
tgactctcaatccttagggtagggtctctcattctaaagatgatcataccccatccttgatctttgggggacttaagcaacttcctaaattcataatatttagaggtgatgtttaaaatcagcacttagtccagattctggggagaagtttgatgatggtccttgaatatttagcacttagaagtgctaggaggatgcctcactaagttacgtaagaagcagaagaggacgagtaccgcctgatggattgaccccgaaaactagctgtgtccaagtagaataggtgtctcgctctgttaagcggtctttaaactatgatagttcgctgtactacaaatatgcataggtgctttacaaagacttttcacttagtgaggtcaagaggctaatgctggtctcatgtataatttaggtacctttttacatagaaccctcattag

SEQ ID NO: 49857 - DNA, 307 bp, Homo sapiens
tctatataataagcttttcatgaaggcttaaagagaaagtacaaattattattgtttttctttgacatttacatccacttactgttcctaaggacaattcagtccctcctcccatgcgtaaacctttctatctgattagatccaggttgttactgatagacataaaattattttataaaaagaaattatgttcaatgtaaaaatagtaatccattttaaattcccttcatttctgcagcctgtttctccagacaactcaaaattgtctgaatcccataagacagtttctctgagcatattgtttaat

SEQ ID NO: 49858 - DNA, 506 bp, Homo sapiens
ctgttcatttccaagggtcatccatttacaggatgaatgctcaagcctcttcctcccggtgccatggagtctgcctgtcagtcccctccttgcccagcatctcccgcctgcctccttgttcccctatgccttcaccaagccatgtctcccaccctgttcacccgagcctctcctctcctttcctctagtgccgcctggctgggacagtgcagaaacactgctcctggcagggcgccctgtgcctgtcccctttcctgctgctctctctgactgtgtgtgtgcagtgagtggggcagcctggccaatcctacctgcctcaggtggatggtggccccaggtgctgctgccactgtctctgtgttctatccatttcccctttccatgggcgttgttcattcacctggtcactcatggccttcagttctcatctcagtctgaggaccccctttggcctcatcagtgtgtcctgcccacactggtgtctcaaactccaggcattaaaaacc

SEQ ID NO: 49859 - DNA, 469 bp, Homo sapiens
atgacaaattcataggttttctaatactactgtagttgttactaatattcttgattgaaggaattgttaatttttgtatagaggttagtgaaaaggttcccatccatattcacagatccctgaattctctatggactccccatattaagaacctcagttagtgaaaattcagctagacctttctccatcatacttcagtaagcgtagtttttcacattctatatgactaatcttaagtagttacaggccgggcacggtgggctcatgcctgtaatcctcccaaagtgctgggattacagatgtgaggccaccacgccgggcctgcttttcaagtgatggtacagtttcttagaagccgttcaataagcagacttcgggcaatatttgatgagggtggtgccttgaatattttcagaagggttactgagattattgatacgatttatgtctaaaaaacagtgtatatacc

SEQ ID NO: 49860 - DNA, 388 bp, Homo sapiens
gtatgtgagtgactctcagcctggttcacagtgtttctatgaactttattgatagatgacaggaaaaggatatcctttccccagcttgcagacactggtatcattggatgaattgagctgtcaaaatgtcaaaccagatgctgatgggaaccacataggttgtcaaacacagtatcattttatactaaattattttaagtgcttgcagttctcaatttcataaaggagaaagggtaggagtcctatctatttataaatagtttacccttttttttttttttgagacagacacactgtcacccaggctggagtgcagtagcgcaatcttggctctctgcaacctgcacttcccaggttcaagcgattctcctgcctcagcctcccaagt

SEQ ID NO: 49861 - DNA, 364 bp, Homo sapiens
cagtctattaggcattcagaaagggcagtaaatgttcagataagaaagcaggttacttatgggtaaaatgctttccttttaccatcttaattttaaaagtagagcccctaaatgagcagaatgagatagctaaacaagtttcttctagtctctgccttttcagaaatccatgaaaaataggaagaactgtaaaaagaaaataggtgttttgtttttacttatcttggcataattttagacttacagaaaagatacaagaacctttcacccagatattccaaatgtccatttttactatatttgctttctccttctctttctcattctgagtactggttttttttggttttttgttttgtttttt

SEQ ID NO: 49862 - DNA, 4928 bp, Homo sapiens
  misc_feature (83)..(83): n is a, c, g, or t
  misc_feature (3209)..(3209): n is a, c, g, or t
  misc_feature (3481)..(3481): n is a, c, g, or t
aagcagcaccagaacaccacctacttcatggccgacatcatctctgacatgtctgtgagctctgaagagttggtttcatgacntgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggntctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtancagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaaccctccccccacgccccccacccccgcaaccttcctgggagtgaagacacggagtccctaccaactgtcccactgtagggaacaaagaaagccaatgtttcttctgtatagattgcttctcgtccgcctctccatatctccccatttcccacacccttgtgccctgtgtctgcctctgtttcatcactgtgtcagaggcccatgtgaaatctttcattctgatgtgagttttataaagatgtacactgtgcttaatccctgcccatccttggtagcccctagtgcaataaagtctccctgagtggtgagttctcccggcaaggaggaggggagtttcttctgcagaatccagcccctcacttccttgcttctcctcccccaggaccaagttgttgaatgggccagagatgcagccagtggggaatccttttcccctcagccactgcaagctggagtgctgatatggtcttctttttctcccaacttcgccactcagcccctgcctgtgtcattccaccgccatccttcacctctccctcagcctcatggagaggaaacattttctaatgtctgtatatagtatatatactacataaaatatataaattatatatatactaatttatgtcttgtttttcaaacaagaatgattaaatctattcatcttactatccc

SEQ ID NO: 49863 - DNA, 4333 bp, Homo sapiens
  misc_feature (83)..(83): n is a, c, g, or t
  misc_feature (3209)..(3209): n is a, c, g, or t
  misc_feature (3481)..(3481): n is a, c, g, or t
aagcagcaccagaacaccacctacttcatggccgacatcatctctgacatgtctgtgagctctgaagagttggtttcatgacntgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggntctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtancagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaatgctttaaacgcgagaaacaccactcatcaactgaacagcacccctcgcctgcagttgaacctcaagatccagcttcgac

SEQ ID NO: 49864 - DNA, 3109 bp, Homo sapiens
  misc_feature (83)..(83): n is a, c, g, or t
aagcagcaccagaacaccacctacttcatggccgacatcatctctgacatgtctgtgagctctgaagagttggtttcatgacntgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccgccatctcgagggatcctctaac

SEQ ID NO: 49865 - DNA, 387 bp, Homo sapiens
aactttcaattttggggctgtgttatgcaaatcaaattttattttaggttggtcatttccccttcatggcagcctcaatcaactcatattaatcttgaaactaacatgataacatctttacctcttcctttcatataagctgcggctgccaggtccctcttcctctgttggcaagtattctgcactgctgcttcctggttgaaccccactaactgtgggtgttgttacacaggatgattcttagcactccacacctcaactcctcaaactgctgtaattggagttcctatttctgttctgcttctctctgcctcaacttgtctttcctgtctgcacccttactcccattccttcctggcttgttccaagaggagtgtcagatagaat

SEQ ID NO: 49866 - DNA, 734 bp, Homo sapiens
  misc_feature (494)..(494): n is a, c, g, or t
  misc_feature (658)..(658): n is a, c, g, or t
ctgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccgcccagtctgttgtcagaccacctgccgccccagctgtggtgtgtccagctgctgccgtccactctgttgtcagaccacctgccgccccagctgtggtgtgtccagctgctgccgtccactctgctgtcagaccacctgctgccgtacaacttgctgccgccccagctgctgtggatcctcttgttgaacctcatattggactatcaaccatgagccagtcaccatcccatgatatgaaagtgtcatttatatcaanttgtccatgtgttaaatggccatcagctttattatcctgttattccactaagtaactggtgaaagggcatccatctacatttaataccactcatttttcccatggatctcttcccagcattcagacctcagatgcatgatgcagttagactaagcctctaagtntctgactgttatgcttgatttgaccttcaaaattacatattaactgttcttcaataaatattatcttaatatcagt

SEQ ID NO: 49867 - DNA, 592 bp, Homo sapiens
gatcgctggaatatggaacacagagggcaactgagaaaatccttgaatttgtgaagtcaaagactattgggaggccatgcctgccatttccctgaaaagcacttcatttaccaaatactaatcagattcgaatggacatcagcccgggcgagttgttaaattattgctgtaatttgaaaaatgagtgtgtcagagtatcagggaagctcaagaatctggccagagctgtcatttagagaggcagaagtggacgtccttgggtgctgagggccctcaggactctcctggcccacaccagtgcctccccacataggcactagttggacaacaagtggaaagatgtggccttccctgctccctttttttttcctttttttaaacttatggtaaaatacgtataacaaaatttaccatctgaatcatttctaagtgcacatttcagtagtgttaagtacattcggctgggtgcggtggttcacgcctgtaatcccagcactttgggaggccgaggtgggcagatcacaaggtcaggagatcgagaccctcctggccaacacagtgacaccccgtctctactaaaaaaaaaaaaaaa

SEQ ID NO: 49868 - DNA, 377 bp, Homo sapiens
acagctgactcatgagtgggatttggaaaaagcgtggactcctgcccatggcctgagtcctttaagatcagaaattatgtctcccatcatggcctctccatagaggcatgtatcttcagcaggcgttaggtcacaagccacatgatgccaagctgacagtggcttgcataatggggatatgtgactgtcgcataactagaattctggaagagtgcagtgccaggcttggggcagctttccagccatgtcattaagaatccagccttctcctggccttcagctatgccacgtggccagtgtctacacctgggatgtcaagagacaggctgcaggtccaccctcctggcctcatactatggaagaggctttccttttgg

SEQ ID NO: 49869 - DNA, 348 bp, Homo sapiens
gaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttacagtaagttttatatattttgaaataattcctcttttttaaaaaacaggtgtt

SEQ ID NO: 49870 - DNA, 483 bp, Homo sapiens
aactcccagtgacattgcgatatgtctggaatggaatctaatcccttctccctaagaggttagtgaattccttagtatggagcagctgagggaattgtctctgtccaagtccatctggatgcttctgactcatctgctgatcctcctctgcgtggatgtctggcccacaccctaaagctaatctgagtcccaaggggcattttcttgtccaaaagttgatatgctaatttcagagaagtgctagcctttctgtctaaaattgctcacagttcacacctcatgtcttgtcttctgctctgtttccttcctaatttggcattacacaggtctgtgcaaagccagactttaaggaagttccctctcctcccgtgtcctctgccaaatgcttcccgtctgtcattggcaaaggctctgtcttgccatgatgggagaggccaggagctgctccaaagctggtggaaagagagccgttccacgttcagt

SEQ ID NO: 49871 - DNA, 380 bp, Homo sapiens
tacaaaaggtatgttgggtgcgacctgcgttgtttctagagtgacgtgttcttttaggagtgcccttgcccagcactcttctaatctggcactctctcataaactggctccagagaaacactttcatgattggccaataacattctggatcaggatgttgtctttttaaatataagaaccctttttcttttgcaatagcttttcctaaagtgacacattttcactgtaaaagattcatctggtgtttcagtgaacattaacaccagatacctctctatgcatacacagacacatgacttaaactgtacattgctgttctatacactgcttttatcccctcacatttttcatgtcactagaaatctacataattttcagta

SEQ ID NO: 49872 - DNA, 450 bp, Homo sapiens
attcctttagaacaagaaggtgttatgcatatttttatgtgtctggcattcaataaatgtttgttaggtaaacaaaattccattcatttctaattttctcatggtttctagtaaaagacaaacactcatcttcaaaatgttatgagagttgggagatgagtggtacaaaaaattgactgaaataataaatttcacggtttctctatcatccatcttgaaataatctctctgtcatggtgtgctcaagatgctttgcttttcaacacctcaaaaaatctttggttggctgggcatagtggcgcatacttttaattccagcacttcgggaggctgaggcaggtggattgtttgagctcaggggtttgcgacaagcctcggcaacatggtgaaaccccatctctaccaaaaatacaaaaattagccagtcttataacctggtctcaaaaaaaa

SEQ ID NO: 49873 - DNA, 481 bp, Homo sapiens
aatgaagtttgccacatcagttgacacttccatgaaagatttctctgtagcatatgatactgttggggtaacatttcaccccacagtataactttcaaaattggaagcaagtactttcagaccttgccagtgcttatcagctgtgttcatgtgatactcattttaacagtctaaacaacatttttaccagagtagatttcacctcaagaaaccattttcggctgggagtaaaggtcgcgcctgtaatcctagcactttgggagtccgaggtgggtggattgcctgagctcaggagtttgagaccagcctgggcattatggtgaaaccctatctctactaaaatacaaaaaatcagctggctgtgatggcttgtgcctgtagtctcagctactcagtaggttgaggcacgagaattgcttgaacccgagagctgaggttgcagtgagccaagatgacaacggtggaaactctgtctcaaaag

SEQ ID NO: 49874 - DNA, 656 bp, Homo sapiens
catcctcacagggttaacaagaattagatgctgggttctggacagaaatatagttgtaattaagcattaatcaggctgcactttggcccacttcttcgtaaccaaaagtcccagagcaccagatgctaaccatttgcctcctcattgttcctacagagaagatttctgatgttagaatcataaggcctttgtttgtttaaaaatggcttaagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaaacctgagatcctcggtgtattgacttgccatgaattaggcaacaaacctattacagttacagttacttttttaaaggaaattcaatcgttggattggtccacctgcttatttcttcccttttcaaaaaaaatgtctacatattgaatttttatacattaagtggttcatgaaa

SEQ ID NO: 49875 - DNA, 482 bp, Homo sapiens
catcctcacagggttaacaagaattagatgctgggttctggacagaaatatagttgtaattaagcattaatcaggctgcactttggcccacttcttcgtaaccaaaagtcccagagcaccagatgctaaccatttgcctcctcattgttcctacagagaagatttctgatgttagaatcataaggcctttgtttgtttaaaaatggcttaagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgca

SEQ ID NO: 49876 - DNA, 561 bp, Homo sapiens
aagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaaggtgagtgcttattatgtgcatacaaattaataagaggcgattatgagaactaataaaaaatcacaacgagtcata

SEQ ID NO: 49877 - DNA, 320 bp, Homo sapiens
gatcgagctctgtaccggatagggagaacggaatgacagcagtctatgacggagctccagaaacatgacaaggaggactttcctgcctcttggagatcagaggaggaaatggcagcagaagccgcagctctgcgggtctactttcagtgacacaggtaaagactgcatttcgtcattacccagaccctcccgtgggcctcaggaaagaggctgcactctcagaatggggatgcacaaaaacaccttcaccagcatccttgggtggtggctgcaaaggacaaagagctggaggggagaaaaccctggcccttgagtactgt

SEQ ID NO: 49878 - DNA, 453 bp, Homo sapiens
gatcgagctctgtaccggatagggagaacggaatgacagcagtctatgacggagctccagaaacatgacaaggaggactttcctgcctcttggagatcagaggaggaaatggcagcagaagccgcagctctgcgggtctactttcagtgacacaggcctttgtttgtttaaaaatggcttaagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgca

SEQ ID NO: 49879 - DNA, 657 bp, Homo sapiens
gatcgagctctgtaccggatagggagaacggaatgacagcagtctatgacggagctccagaaacatgacaaggaggactttcctgcctcttggagatcagaggaggaaatggcagcagaagccgcagctctgcgggtctactttcagtgacacaggcatatcaagaagacaaggtgcatgggggaaaaccaaagagtcagcttccctagggctgatgggtcaaatctcagtgcttgcctctgacattttgcttgccgacagtctgtcttgaaaaccaacaggttgcaaagaagaatgtgaacacctatatccagagatgccctatataagaataaagactataagaccaaaaagatgttcttgacttaatgtttggggtggacatacctagttatacgatttggctgtttccccacccacatctcatcttgaattgtagctcccataatccccacatgtcatgggagggacccagtgggaggtaactgaatcaagggggagggtctttcccatgctgttctcatgattgatagtgatggttttataaaggacatttcccctgaatacgctgtcttgcctgctgccatgtaagatgtggctttgctcctcttttgccttcctccatgattgcgagtccattaaacctcattcctttat

SEQ ID NO: 49880 - DNA, 1089 bp, Homo sapiens
aagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaaacctgagatcctcggtgtattgacttgccatgaattaggcaacaaacctattacagttacagttacttttttaaaggaaattcaatcgttggattggtccacctgcttatttcttcccttttcaaaaaaaatgtctacatattgaatttttatacattaagtggttcatgaaa

SEQ ID NO: 49881 - DNA, 915 bp, Homo sapiens
aagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgca

SEQ ID NO: 49882 - DNA, 107 bp, Homo sapiens
aaattaaggtgcactctgttcccgacgattccatctggctgggctgaggtggagtcccctcgattccccagtgagggctgggaacccatcactcgctccagcaacag

SEQ ID NO: 49883 - DNA, 1153 bp, Homo sapiens
cccaattctgatgtaacagccttgggaaagaggttgcagtgaaaagctggtcctgctgtggtggagagaatggaggaaagataataaaaggccaaacctttgctccaactttctccttagcttccctttggatctggaaagctggggacccacacggcagagccatggtactggaggagccattaacaaagctttcaataaacctctctttcttgaagttacctgagaatggatccattccctgcaactgaagattctaaggaactgggtttctcagtatacaatgggaatggttgggaggaggtaaagagtagaagacagtatcaagaatccagagcccagcacctgtagtcctaactattcagattccttgagcccaggagtttgagtccagcctggacaacatattgagacccccatctctctaaaaaaaaagagaaagaaagaaggaaagaaaaaaagaaagaaagaaagaaagaaagaaagaaagaaagaaagaaagaaagaaagaaagaaagaaagaaagaaagaaggaaagaaggaaagaaggaaagaaagaaagagaaagaaagaaaagaagattgtagctagggggagagtaggtgaaaagatgaacaacatgaccgggaagatttcctaatctcaccacagcctggctctaccttaagtctttaataaaagcttgactgaaggtaccaaggtgtgctgaagtggaagcaaagttctccaaagtccagcatggtagacatcagtggtggtaaccaaggacagaccccaaggcaaggtgaacctcaaaaatggaacctcaagtctatgcagtccagctgccctccccaccagaaagtccttgttccagcccaacatcagtgcctctgagtttgtttactagaaacaaaggaagaatttccttgtaaaaatatagacagagtagtccctggctttctcctcttgcaggaaggatggattctcccattccataccatctttcccccacactggccccagaaatacttaattcaactatgtgaaaataaagattgtttttggtttgagggcatagggatccatttatccttattctttatgaggcactaaattagctttgtatgttattaaatgtgtctcgtcaatgctgttggcattgtttcatttt

SEQ ID NO: 49884 - DNA, 1300 bp, Homo sapiens
cccaattctgatgtaacagccttgggaaagaggttgcagtgaaaagctggtcctgctgtggtggagagaatggaggaaagataataaaaggccaaacctttgctccaactttctccttagcttccctttggatctggaaagctggggacccacacggcagagccatggtactggaggagccattaacaacgaggctccttctgtaaggttgcctggatactgcatctggctgacagagtccccagacagaacttgaataggcactgccagggtgtgtacttctatgactctccttttgcaatgggcccacaccacccacctcatttttctaataagagctttcaataaacctctctttcttgaagttacctgagaatggatccattccctgcaactgaagattctaaggaactgggtttctcagtatacaatgggaatggttgggaggaggtaaagagtagaagacagtatcaagaatccagagcccagcacctgtagtcctaactattcagattccttgagcccaggagtttgagtccagcctggacaacatattgagacccccatctctctaaaaaaaaagagaaagaaagaaggaaagaaaaaaagaaagaaagaaagaaagaaagaaagaaagaaagaaagaaagaaagaaagaaagaaagaaagaaagaaagaaggaaagaaggaaagaaggaaagaaagaaagagaaagaaagaaaagaagattgtagctagggggagagtaggtgaaaagatgaacaacatgaccgggaagatttcctaatctcaccacagcctggctctaccttaagtctttaataaaagcttgactgaaggtaccaaggtgtgctgaagtggaagcaaagttctccaaagtccagcatggtagacatcagtggtggtaaccaaggacagaccccaaggcaaggtgaacctcaaaaatggaacctcaagtctatgcagtccagctgccctccccaccagaaagtccttgttccagcccaacatcagtgcctctgagtttgtttactagaaacaaaggaagaatttccttgtaaaaatatagacagagtagtccctggctttctcctcttgcaggaaggatggattctcccattccataccatctttcccccacactggccccagaaatacttaattcaactatgtgaaaataaagattgtttttggtttgagggcatagggatccatttatccttattctttatgaggcactaaattagctttgtatgttattaaatgtgtctcgtcaatgctgttggcattgtttcatttt

SEQ ID NO: 49885 - DNA, 920 bp, Homo sapiens
cccaattctgatgtaacagccttgggaaagaggttgcagtgaaaagctggtcctgctgtggtggagagaatggaggaaagataataaaaggccaaacctttgctccaactttctccttagcttccctttggatctggaaagctggggacccacacggcagagccatggtactggaggagccattaacaaagctttcaataaacctctctttcttgaagttacctgagaatggatccattccctgcaactgaagattctaaggaactgggtttctcagtatacaatgggaatggttgggaggaggtaaagagtagaagacagtatcaagaatccagagcccagcacctgtagtcctaactattcagattccttgagcccaggagtttgagtccagcctggacaacatattgagacccccatctctctaaaaaaaaagagaaagaaagaaggaaagaaaaaaagaaagaaagaaagaaagaaagaaagaaagaaagaaagaaagaaagaaagaaagaaagaaagaaagaaagaaggaaagaaggaaagaaggaaagaaagaaagagaaagaaagaaaagaagattgtagctagggggagagtaggtgaaaagatgaacaacatgaccgggaagatttcctaatctcaccacagcctggctctaccttaaggtaggtagatggacaagtatagctacctgggtcacagatgctaagatgacatccagacaggtcagaaattaagaagaaaggcagatgaggaaggataaaccctatcttataagacaaattcctggcactcatttcttttttaagtttcctttttgctttccctagtcctgcatttttgttgaaggcagaagattagagagagacaaagaatggctgagttgatatccttgtagttacagtctgagttcccag

SEQ ID NO: 49886 - DNA, 236 bp, Homo sapiens
aattactaactgaattcagcaaagactgatgaataaagtttgaaatgaaacacaagtaagtaataagtaatatttctcttatcttactgtggtttcttatacagatcaagctaaaatgtaactaagtgtctatttaaagatgataataacataaagttcattacttgggtataaacacagctgaggtaggtgctgaggataggaaatggaaagagcgaccatctgagaattagaaa

SEQ ID NO: 49887 - DNA, 367 bp, Homo sapiens
gcctcgtgattctgctgtgttgtatggcacagttgacctttaggtagagagattgtgcaggtgcctgatctagctgcaaagagtcctcaaaagcaaaaggggagccagagagattaggaatgatggcgggaagagctccacacatccaggtgaaggtggaggggctctgtggcttttaggaacagtgggacatccccagctgacagccatcaaggacctgcacagccgcaatgaaccggtgcctggtaatgatttctcccagagcctctgcaaaggaatgtagccctggctacaccttcattacggcctgtgagacagaatccagcaggacttctgacctacagaactgtaagctaatcagagggtc

SEQ ID NO: 49888 - DNA, 344 bp, Homo sapiens
tgatgtagcaacatgcaggccaagaatttctctaggccccagtgacatgggggctaggtttctctccaccttcttggcagtgtgtggctgagaaaatccctgctctcccttgtctgtggttgagagctcccaaagatagagttcagaatcatctttctaaatcaacaagaggctctttcatcttaattataacagcttaaacttttagagtaagtcaacgtttaccatcattttacgtgtgcttattatcaaaggtggatctgaaggaaaaatgattgattaccttcctaaccgttttaatacttttatatttattggcagaatttgagaagggtttgagctgt

SEQ ID NO: 49889 - DNA, 435 bp, Homo sapiens
catggaacagctgctctggcctgttgcctggactggagatggctgaggacggcatccctccctggtgtcctctgttgaagactgtggcgggtccttgcctgtctttgcttggccatgcctggtggtgctctggcgggctccacttcacttcatctctcatggcatgattcccctctgggtctctgtcttatccttcatcctgctcttgccctagtggtccctgaaacctttgtagtggcattatctctcccgtaccactgtgggctctcaacccatcccagcccgtctgcacctgctcactcccatccacctctatccagacaggatttttctgggtctgtgtaaacaaaagtcagggccacagaggaaggatacactctagccattgttctctctgactttgctgtagcactgagttttctttgatgtagctga

SEQ ID NO: 49890 - DNA, 167 bp, Homo sapiens
actccctctttctgctcttcagtctattgactttgggcacaggcacagctgcagctctagtaggggttgggcctggagtcagtggagacaaaatgtgaaggtaacaggacagtgcacggggcccagtgtgctctgcctgggctgctcagggaagaaaaatcacacac

SEQ ID NO: 49891 - DNA, 486 bp, Homo sapiens
cagtaaaaagtctggtagagagagtgggggactcacaccaaggcacagagtggtgtctccctataatgacctcatgttttaggatccaccttacagtgtaatcactggtggcatggggaagttagagcatggaatttccatcttcagctgcaaaatttatttttcttaatcatttaattctaaattaaattttaaaattctggccagctgcggtgtgtcatgtctgtaatcccagcactttgggaggccgaggcgggcgtgtatcccttgaggtcaggagctcgagaccagcctggccaacatggtgaaatcccatctctactaaaaatacaaaattagccaggtgtggtggcacctgtatgtaatcccagctacttgggcagttgaggtaggagaatcacttgaacctgggaggcagaggttgcagtgagccaagatcgcgccactgtactccagcctgggcaaaaacagcaaaactcttgtctc

SEQ ID NO: 49892 - DNA, 887 bp, Homo sapiens
aagttcatttatatgactcttctccagattgtttctgtgtcactaaccagccaatatagtagccactgcagggcatgaaacaggcctacttgctacaccttagttatctttaaccaagacatacacagcgtctcaactctggttaggccaccactgagtccaggttttgatttgacagatgagcaagctcctagaactgcattcagtcgcccaggttggcacgtggagtccagactccctggtaagctcacccatgttaataaactcaatatagtctataattacatttctctctctttggcagtcacctgcagaatctgtatgcgtggatacttaccccagatctttgccttctaaattcaatgggctgtaaatcttctggtgtgtaaaccttctgggtttgactttgtaatattttttctctggaacatgcaggaaagtggccagttacagacttggggacactgagaaggggagggaacgtggtggtgtggaatgggctgagctctctccctcttacaggaaactccctctggcgggggaatggcaggcctatgaggaagtaagcgttgtccttttcaggggagtgacctagtgctgcatccaaaaattctcattcctgttctcagggcccagttttgacccctgcaggcaatgccctgactttcgcataaagtatgtggggaggctgtgaattcaagtaatttggcagcctatagattctcactaacctagagtttatatttcagctgccttagcactacagcttcaagagataagacaatcaagcctgtgtcgagttaagaattaaatgggaggttgcagtgagccaatatcatgccactgcactccaggctgggcgacaggataagactccatctcaaaat

SEQ ID NO: 49893 - DNA, 2616 bp, Homo sapiens
ggcagccgtccggggccgccactctcctcggccggtccctggctgccggaggggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttc

SEQ ID NO: 49894 - DNA, 2461 bp, Homo sapiens
gaattccgagagccccggcgggcagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttc

SEQ ID NO: 49895 - DNA, 2765 bp, Homo sapiens
  misc_feature (7)..(7): n is a, c, g, or t
  misc_feature (39)..(39): n is a, c, g, or t
  misc_feature (49)..(50): n is a, c, g, or t
  misc_feature (55)..(55): n is a, c, g, or t
  misc_feature (58)..(58): n is a, c, g, or t
  misc_feature (62)..(63): n is a, c, g, or t
  misc_feature (91)..(91): n is a, c, g, or t
  misc_feature (215)..(215): n is a, c, g, or t
  misc_feature (230)..(230): n is a, c, g, or t
  misc_feature (257)..(257): n is a, c, g, or t
  misc_feature (259)..(259): n is a, c, g, or t
  misc_feature (269)..(269): n is a, c, g, or t
ttaagangtgtttgttgaatgaataaataaatgatggancagctctgtnnaagcncancttnntatgcatttttaaaaaattgtgtttgcncatttgtcctaccagctgtaaaaacttgctagcaaaagagtggcagaaggcccaacatttttagaaaattcttagccgtaaaccttaaatcccgagttggaaaattctcattattaaatgccangagttggtcttcctngagacctctgcaagaggccctctcacngncaccttgtgnccatttttcctgccagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttc

SEQ ID NO: 49896 - DNA, 2632 bp, Homo sapiens
agccagatgctgactgcctgtcagaattcagtccctacacaccccgccccatgtctgtctgtcttgcttcatggaccactcacaccccagagttccgcctgccttctctgttgcccaccaaacccgtgtgtgtttgttcgttcatatgcaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttc

SEQ ID NO: 49897 - DNA, 1023 bp, Homo sapiens
ggcagccgtccggggccgccactctcctcggccggtccctggctgccggaggggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggtctcaagacaccccccaaccaactccaagggtccccacctaaccattaccaagagggctcatcttatgctcaggtgggggcttgggaaacctcagcaagggttaggtctaggctaaaggaattcccaggagc

SEQ ID NO: 49898 - DNA, 315 bp, Homo sapiens
ggcagccgtccggggccgccactctcctcggccggtccctggctgccggaggggcggccgcgcgtggatgcggcgggagctggaagcctcaagcagccggcgccgtctctgccccggggcgccctatggcttgaaggtaagcaccggccggatggagcggcgggcgactcagtgtcacggggagaggaggagggacctccaaggggagcgaggccaggaccagaagtttgtgcggccactcctggccgcctgctcgggagcgcccgcctgggatccggctctgcatgggctccccgtcgggcgggggcagagggc

SEQ ID NO: 49899 - DNA, 2787 bp, Homo sapiens
  misc_feature (90)..(90): n is a, c, g, or t
  misc_feature (160)..(160): n is a, c, g, or t
  misc_feature (173)..(173): n is a, c, g, or t
  misc_feature (175)..(175): n is a, c, g, or t
  misc_feature (203)..(204): n is a, c, g, or t
ccggcagcctcacgcgcgcaccgcgcctccgccccgtccccgcgctccctcctgcccgcccgccccggcccggccccgccccgccccgcnccgccgcggcccgtccactgctccccgcgggccagagccggccgagctgctgcccgccggggctctgaanggccggcggggcngngagccaggaccggccgaggagagtgcgnncccggacggctgccggaggggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttc

SEQ ID NO: 49900 - DNA, 3088 bp, Homo sapiens
  misc_feature (90)..(90): n is a, c, g, or t
  misc_feature (160)..(160): n is a, c, g, or t
  misc_feature (173)..(173): n is a, c, g, or t
  misc_feature (175)..(175): n is a, c, g, or t
  misc_feature (203)..(204): n is a, c, g, or t
  misc_feature (2953)..(2953): n is a, c, g, or t
ccggcagcctcacgcgcgcaccgcgcctccgccccgtccccgcgctccctcctgcccgcccgccccggcccggccccgccccgccccgcnccgccgcggcccgtccactgctccccgcgggccagagccggccgagctgctgcccgccggggctctgaanggccggcggggcngngagccaggaccggccgaggagagtgcgnncccggacggctgccggaggggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttcaaaaaaaaaaaaaaaaacaacaaaaaacacaccgggggacataagcggcggcggggacaacgggtagaacgggagctggctaagtgtggcccgacccctttctgtgaaggggaaacgggcgcccacaaggaagggaatacgaacctgactgacgccgccgcaacgngaagaaagcgcaacgagaaacaagaaggacagagagcagcacacagacagaacgataacaacatcacatacaaacacgacacaacaacacaagaaggccggccgaccgaccggccaagaacccaagagaccgtgc

SEQ ID NO: 49901 - DNA, 2495 bp, Homo sapiens
agccagatgctgactgcctgtcagaattcagtccctacacaccccgccccatgtctgtctgtcttgcttcatggaccactcacaccccagagttccgcctgccttctctgttgcccaccaaacccgtgtgtgtttgttcgttcatatgcaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttc

SEQ ID NO: 49902 - DNA, 511 bp, Homo sapiens
tcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaaaggtacccaggacccgggggaatatcccgggctccggggtacaaagaaaaaatagtcacaaagaatgagtaacacttactacttgctcaggtgtggtggctcacactctgtaagcacagctctttaggagcacaaggcggacagatcgcttaagcacaggattcaaagactagccgggcaacatggcaataccccatctctactaaatatacaaaaaatagccaggcattgtgggcacacttgtagtcccagctacccagatccggggatgagatcctgtagatcgc

SEQ ID NO: 49903 - DNA, 2029 bp, Homo sapiens
tcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggagccagcagctggagcgtgctctgagtttcaggggaccccccacccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcactactgaatactcctttctgtttacaccagcagtgaatagagtcatgaaaagaacatattatatgcaatggcttgatgcttagtgtggcaatcaaaagcttgcctgggcagatgtaggcaggggctagacaatagtcatggagttgtcaccaggtcactgtctctctccttccccttccaggtctctactgtcccctgcagccaccacaagggctaagctgttgaatgagccccttggtttttccttataaacgcaatgacttacttgtgattcttggtctaatcccaggctaagaaacaaaacaaaagcttgtgatctgacccattcctttgctgccttccttctctttcaggcacctggacgtatttagtattctgccctgtgccttgcccaggggagggagaagtttctagcaaatgtggctttctgtctgctgcctggtgcttttatagtacttcatctgctttttattgttgttgttgtgttttttaaccaaaatggcatttgtttggctgtcattgtcgagtatatatttattgtgttttacaaacatgagtatatatgtatgtatatgtataaaaccaaacttatatatataagaagtcaaggcatgtatactagatattttaaagagttatttatcaagggaaaaagatgtgtgttataaagtaaacagagtctatattttctatataatgtagatagtcaaacatagcttataaattataggaggttttggttttcttttttattattaaaggaaaaaaagaagaaaaaaaaagacaatgaatgcaactgttcttagtgtttttaaggccaaactactgtggaagctgggaggcggccctccctgcgggcctccagcagccctgtgcctgccgctaggagctccagagctgatgcccgttgtgatctctgcgatgctcgatgctcggagccagcggtcagcatcactcagccagctggcctgtgccgctctgacgtggcttccagctgttctccgcaatttgcattggtgggataaaggaatgaaaaggataaataaagatttaaaagaaaatacaaaaaaagctc

SEQ ID NO: 49904 - DNA, 857 bp, Homo sapiens
tcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggactccagagctgatgcccgttgtgatctctgcgatgctcgatgctcggagccagcggtcagcatcactcagccagctggcctgtgccgctctgacgtggcttccagctgttctccgcaatttgcattggtgggataaaggaatgaaaaggataaataaagatttaaaagaaaatacaaaaaaagctc

SEQ ID NO: 49905 - DNA, 518 bp, Homo sapiens
tggcagttagcccgcccgctcggcgcagggcgtggcttctcgtagccattaggaaacagcaaccctttcacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49906 - DNA, 1136 bp, Homo sapiens
  misc_feature (530)..(530): n is a, c, g, or t
tggcagttagcccgcccgctcggcgcagggcgtggcttctcgtagccattaggaaacagcaaccctttcacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaanaaaaaaaaaaaaaaaaaaaaaaaaaaaaaaaaaaaaaaaaaaaaaaaaaaaaaaaaaaaaaaaaataaaaacaaaaaaaagaagagaagaaagaagagaagagagaggaggaggaggcagaggcgacagagtatatatattattagtagcagcgagagcgacgaagcgattgatgggcgaggagacgtggcgtctatctctctatatatacataacacgtgcctccactccctaacactaactcatcatataatatataaattaatcatcaaactatattatacccaaaaacatatcctatattcatattatacaaacaactacctaaaaaaactaaaaacatcagcatatcctagaatcacacaatccactcaactacatctacaaacaataacaaacacaaaactattcccttgcagccttcaacactgctcctatcgaacaaacagatcattaatttcacaataaacatattatatctccctattacaaatcactccccaatccctcgaacctctactatacatccccctcgtgcaacaacctaatcagatcaaactatcatcactcacacatacctaccacttccttaccctcccttcttca

SEQ ID NO: 49907 - DNA, 759 bp, Homo sapiens
agcggaagagcagaggcttggaaattaggaaacctggatttcagtatcaagctgtgtgatcctgtgcaattaatcccctaagcatcaggattctcctctgtaaaataggaataataagagacccttctaaatgtggctcttgcaggaaaaacatgagataagcatacttttatgccagtaaaggacttagcaggatgcctggctcgccgaatctctttcccccttggaaacttcttttatctacctctctgcccctgactcactggaatcctacaaatgggacatctcaggcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacaggtaagtttctgtttaatatgtaaatcatagctgctgactgtacattttatctcatttattctatctggctttaatttgtcttccttgaggtttttattgtttagtgagcacttgctagctgattcttctttttggtcttttagacagggtactctcctggagctaatcatattcacctttagcctttacctagtgtatagccttggtattacccagagtttcctcttattgaaattattcttcttattactc

SEQ ID NO: 49908 - DNA, 867 bp, Homo sapiens
gcgactaagaccacgtatatgtactgagatgatacttataagttcatatggtcttgtagcacaatataaggcaaaaaatttattcagcagagagatttctcattgccactggtgaaagaccacgttacttgggcatccctggtgacaaagaatactgcatcagcaggtaaaggaaaaaagcagggtggaaaagaaaaacccattgtggatattgctttcgcatttttcttcaaacccactgcgtcaatttcttgggcttcagacagatttctttgccacattgtgccctctctgggggcaggggtttgggagaaagagaaaaaggaaaaatgattttaaaggagaacattttaaatattgaaaacttcaaacattggtcatcttgctacacagagtatcactaacatactagtatagatttacatttgtattcgaaatttatttatgcatgtatgagtatgaaagtatgtaataaaaccaaatggatattcacaaacattttgtaaaataggtatgatacatatatacatttagattttgtaaaatgaggatcatgtattaccctttaacacttgcagagtggctgctaaaagaattagaggctgtcaggccatttagatttatcagaatctagaccctactcaatgctgtttgaatggttgcagtgtcagtgtagaaggacctcctgaaacaagtcaagcaaggagatgttttgctgtgtggtttatttttgcccgtcaaatggtaacactgctgacattgttcaggagctttcaattatgaagtcattaagacagagtgttggtaaatgtgtcttcttggatgctttttgctcaggagtttctgattgtgttataaattactcta

SEQ ID NO: 49909 - DNA, 3908 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49910 - DNA, 3671 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49911 - DNA, 3843 bp, Homo sapiens
tccgtcagttcccacagggccttgtgcgacatgggctgcgccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49912 - DNA, 3627 bp, Homo sapiens
aacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49913 - DNA, 3561 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49914 - DNA, 3798 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49915 - DNA, 3435 bp, Homo sapiens
ctacatcagaatctcttggattttcttacaaacacagaatcctaagccttaatatatcccagaaatcagtaaaattcaagttcgtttctagataaagaaggaaaaagtttgtgtattgttattttagtttaaaattgtcaggggatctgtcttgtattatttaattgtattagtcttataagagaatacttgaagatgaaaaagtggcatatgtgctcaaaatggaggatttgccctttcagattgccttttagagctctgctccctgtatttcacttgagtggttattgagaaatgatctttgccagcagttgaaaagccaaacaagattttgttttattttcttatacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49916 - DNA, 3625 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaagtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49917 - DNA, 2700 bp, Homo sapiens
tactatacggtcgtttagtagcgaggcctgggtggcgacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49918 - DNA, 3071 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgtatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49919 - DNA, 4289 bp, Homo sapiens
  misc_feature (3683)..(3683): n is a, c, g, or t
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaanaaaaaaaaaaaaaaaaaaaaaaaaaaaaaaaaaaaaaaaaaaaaaaaaaaaaaaaaaaaaaaaaataaaaacaaaaaaaagaagagaagaaagaagagaagagagaggaggaggaggcagaggcgacagagtatatatattattagtagcagcgagagcgacgaagcgattgatgggcgaggagacgtggcgtctatctctctatatatacataacacgtgcctccactccctaacactaactcatcatataatatataaattaatcatcaaactatattatacccaaaaacatatcctatattcatattatacaaacaactacctaaaaaaactaaaaacatcagcatatcctagaatcacacaatccactcaactacatctacaaacaataacaaacacaaaactattcccttgcagccttcaacactgctcctatcgaacaaacagatcattaatttcacaataaacatattatatctccctattacaaatcactccccaatccctcgaacctctactatacatccccctcgtgcaacaacctaatcagatcaaactatcatcactcacacatacctaccacttccttaccctcccttcttca

SEQ ID NO: 49920 - DNA, 3618 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcgcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49921 - DNA, 1915 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgccctgggcttacaaccgcccaaaggccccttggaactcttggtatagaattggg

SEQ ID NO: 49922 - DNA, 273 bp, Homo sapiens
ggattacaggcgtgagccactgcgcccggccagtctctggtcatttttgagttggatttttaagaaacagactggagaaatgctctaagctgtgtaggaagaggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatcca

SEQ ID NO: 49923 - DNA, 439 bp, Homo sapiens
gcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatatccacgtgtgccttcttactgaatga

SEQ ID NO: 49924 - DNA, 2101 bp, Homo sapiens
gactagttctagatcgcgatctagaacagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 49925 - DNA, 3704 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatataatcgacgccgtggtcgacgatatcccgtacc

SEQ ID NO: 49926 - DNA, 3959 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctcctatctctccccagtcctagctgcttggcaatcacatatactactaacagaccgcaacctcaacaccaccttcttcgaccccgccggagggagggagacccaattcttataccaacagcctattcttgatatttacggtcaccctgaaggttataatatcttatcctaccaggcttcggaattaatctccccatactgtacccttactactccggaaaaaaaagaaccattgccatacatagggtatgggtctgagcttatgatattcaatgggcttcctaagggttaaaatcagtgtggagcacacccaatattattaccaggtacggaatagacgtaggcaccacggagcataatttcacctcggtaaccattttcatcggttatccaacgggggtcaaagatataagcttgagtcgccaaattccagaagcaatttgaattgtctggtgagtggctggagcctagaattaatctcttttcacggtggtcgctgacggattgttacgcacttccctaacatgactaacaaccgaccaggggcact

SEQ ID NO: 49927 - DNA, 1548 bp, Homo sapiens
tggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcaggtaaaggaaaaaagcagggtggaaaagaaaaacccattgtggatattgctttcgcatttttcttcaaacccactgcgtcaatttcttgggcttcagacagatttctttgccacattgtgccctctctgggggcaggggtttgggagaaagagaaaaaggaaaaatgattttaaaggagaacattttaaatattgaaaacttcaaacattggtcatcttgctacacagagtatcactaacatactagtatagatttacatttgtattcgaaatttatttatgcatgtatgagtatgaaagtatgtaataaaaccaaatggatattcacaaacattttgtaaaataggtatgatacatatatacatttagattttgtaaaatgaggatcatgtattaccctttaacacttgcagagtggctgctaaaagaattagaggctgtcaggccatttagatttatcagaatctagaccctactcaatgctgtttgaatggttgcagtgtcagtgtagaaggacctcctgaaacaagtcaagcaaggagatgttttgctgtgtggtttatttttgcccgtcaaatggtaacactgctgacattgttcaggagctttcaattatgaagtcattaagacagagtgttggtaaatgtgtcttcttggatgctttttgctcaggagtttctgattgtgttataaattactcta

SEQ ID NO: 49928 - DNA, 528 bp, Homo sapiens
cgttttcatattgaaatgaatcttacaaggttcagaagagcttattggatactgtgtgcctgagtagcgctgctcatggactggggagcttccctgtggagtggtcggatgtttgagccagttcctcaaatatcagtatctctccggaggttttcctctggggccattccttctcagagaagaatctcctaatctcctgtgaggggaagttgggacagctctgaggtgcctgaaggggctgagtttctcttcctctcctaagcagaaacagggtgctcttaaaatagcctttggagctttgtgatgtgaatacaaccacacagcccttctcagaatttgcttattatggaaaataaaaatcactaggaataggcaccccccgcccccccgcccccaattcattctcatggctgattttaagaagctgcatcttgactgttgctaggtggtttcagggtagaaagcatccaacttccagtcctgggctgccttcacagcatttcagattcatgctgcatggtgcggccg

SEQ ID NO: 49929 - DNA, 484 bp, Homo sapiens
cgttttcatattgaaatgaatcttacaaggttcagaagagcttattggatactgtgtgcctgagtagcgctgctcatggactggggagcttccctgtggagtggtcggatgtttgagccagttcctcaaatatcagtatctctccggaggttttcctctggggccattccttctcagagaagaatctcctaatctcctgtgtaggggatgtaaacctgggtgctggcattctgggagccaggtgggcaagggtcacgggctcttaccattcagtgcacgaagtttagcttttgccttctgcttttcagtctgatgtctcatctcttctcccttccaagctgtggctcccagggttgagaatatgaagatcaaacttttcagtgtggattctgtaggctggaaataaggcgatcccttttctgcctgtcgtaaaggtcacagccgacactcctataccaaaagacagattaacaagagtaagcca

SEQ ID NO: 49930 - DNA, 368 bp, Homo sapiens
agctgccttgtttccaaactgttcagaaaggaggagtcaggaggggaagttgggacagctctgaggtgcctgaaggggctgagtttctcttcctctcctaagcagaaacagggtgctcttaaaatagcctttggagctttgtgatgtgaatacaaccacacagcccttctcagaatttgcttattatggaaaataaaaatcactaggaataggcaccccccgcccccccgcccccaattcattctcatggctgattttaagaagctgcatcttgactgttgctaggtggtttcagggtagaaagcatccaacttccagtcctgggctgccttcacagcatttcagattcatgctgcatggtgcggccg

SEQ ID NO: 49931 - DNA, 377 bp, Homo sapiens
cattcctactgttaaagttttcacttaagagtataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctccaacgaagtgtgtttattaagaacagttcttatgtcattcttaaggtaggtagggttaatactctccagcaaatttagtagatactctttgccagaaaagagaggagtatatatagtttgataattattgtgtagttttctgtgtacttaatttttgcagttttgta

SEQ ID NO: 49932 - DNA, 652 bp, Homo sapiens
aacaattggaagctatatttaatcagataattctggggatgcctattatgaatatgacctgattttaagggatcttcattgttttttagggcttgacttactatacagtggtcttcctttgtttagtttgctgtttcatgtaatctgcctgtatacttctgacacttctgataaataggtcttttaaaattactgttttcattcaattgctttttcttgccttgaatgtcctacatagtctgtttctgtttctagccatttctctcattattttaatgccacctgatttagaagcagttttttttttgagacagagtctcggctctgtagcccaggctgggagtgcagtggcgcagcctgggccccactggcaagctgcgcctctcaggttcacgccattctcctgcctcagcttcactagagcagttttaagtaataggaatgattatagcatctttgccttgttctttgacacaagtgtttctagtgttctgccattaactattagatttattggttgaaggtttgagagatttcttttttcctgatgttaatgaacattcttaatgaagacctttccgttaatgaggaatgtttaaaaatcaagaatgttgaatttgtttctgttttttgagactgcctcgccaaatgt

SEQ ID NO: 49933 - DNA, 275 bp, Homo sapiens
taaatatgaatatagctagttagcctaaaatttacacaaaatgtattcaagatcaaattagtgaacaaagcaatggttcgtatggctaatttaaaagcaattcaatttaccaatattaaaataattataaaatgtaaaagaaatttcagaggagttgattgaaaattttttgttcagtaattattcttaaactgcattcttaggtttattacataaatatagttgccagattgccatgggcaagtgaatgtcttcatttgaaatattattagaga

SEQ ID NO: 49934 - DNA, 347 bp, Homo sapiens
ttaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtag

SEQ ID NO: 49935 - DNA, 491 bp, Homo sapiens
gccatagggaagctgaaagtgcagggcgaggtctctctggaaaaggaaggctcctcccagggctgagggccagctgcagggctgcagcgctgtgggggtaagggctgccgcgctctggcctggagggacaaggccagcacacggtgcctcaaccaactggacaagggatggcggcagaccaggggccaggccaaagcactggcaggactcaggtgggtggcagggagagaaacccacctaggcctctcagtgtgtccaggatggcattcccagaatgcaggggagagcaggatgccgggtggaggagacaggcaaggtgccgttggcacaccagctcagacaggggcctgcgcagctgcaggggacagaggccaatcactgtcacagcagagtcaccttagaaattggacagctgcatgttctgtgctctccagtttgtcccttccaatattaataaacttcccttttaaatatatttatttgcaagacca

SEQ ID NO: 49936 - DNA, 560 bp, Homo sapiens
taaaattcgttttttttttcaaggcagagcagtcaattgattataagtatttatttcttttttcttcttggagcccagattaaaaagagttattttagatttaaaaatttcctgaaatagttgaaaaattatttttgaggagaaaattgtatccaagaaacccagaatgtaaggatacttgatttttatatccagataattctttcatgcactgaatggaagacagtatatctgtatattaatttttgtttagattttgaatcatttaacccttatccttttttcttgtaataagactatttaatgtttttctcttgtgttttccatctttatcaatgcattcgtgttggtcttgatgtatactacctgttcctagtgttatttttacacgtcatctcacagtaataatatcagcaattcttgctgcattgaacatattaaatacacatgtaaaatgaaaaagtaagcagtaggtaaaatcttgttactctgctttcattctgcctaactcactgcatttgaaaatacatgtcaaattctttctgagggtatgtatgatt

SEQ ID NO: 49937 - DNA, 611 bp, Homo sapiens
cagtgcattagaaacacaaattacagatgtctagggttaggatttctcaaagtgacactattggcatttggggccagataattcttgattctgaggggctggcttgtgcgtttcaggatatttagcagcatgcctggcctctaccccttagacgcaagaagtatgcccctgttttgacagccaaacatgcctccagggtattgccaaatgttccttgagggacagaattgcctctggttgagaacctctggtctctggggggtaaaggctttgtatgggtgcctgatgtaggagtgggcacttaatttgccattagtaaaaaatatataccattatttgaacatttaatgaacaatataaatttatgggtagtaaccctgaggaaaattacctataaatgtacaaaaacctgtagtatataatatcctaacacaaggcctgcagcatacaaaaatcactgtacttagaagttcagaatgttttgaaaggatctttaatttcttgagtctttagtcctgaatcatctaaacaaaatatagcattatcgtaaaatgctgaaaatttataaagaaaagttacctttgaagtactctatcccatatagtctagaa

SEQ ID NO: 49938 - DNA, 732 bp, Homo sapiens
attaaagagaccttgggcaaattacctaatctttcacccttggttttctcatatgatgacagtgcctttctgatggagccgttatgaaggtaaacattaggttccaacgcatgggaactacagttgtgttaaaatgagaatttcccaggagttcgtgtgtttcattgtgaggtgctattcagctctgtctatttccctcacatctgtcctttctctttctcatcccccactcacttagtaaacatgtctgcttggaccaatgattgggagtatggcgtgctgagccctggtaacgggaagtaagccagcattttcaacaagttgctaattataccacttttaaacacaataagagaagaaggaatgaaccccatgagctggggccacttggcaagtcccgatggtcttcttaggccagtcaggatgtttcttagactcacatcagccttgatgacgatctcctcccacatcgactgagtcaggggtcgctgtgtgctgagtaatgcagtcctttgctgggcgggaagtgggcagcactctgaagggacatgagagtggatgacggtgaagctgtgggaaactgcgggggagctgcacacgcctgatgcctgtgtcagagccacgcagtctctgagtcgtgttcccaagcacaactcacatctgtgaagtacatcagggaaaattaaataagtccaagtaggaaacaagttcagatatatttggaagatatta

SEQ ID NO: 49939 - DNA, 452 bp, Homo sapiens
agaaatggaaaatgtgactctcaaggattatacacaactaaaactgtgtgaaactgcaatgagtacccgggcaatagggaagtaggaatttctcaccaacccacgtgccaggatccagcctcaacacttgtgaggatccagcctcaacgctctgcacatctccagtgtggaacagcaccatgcgcctaatgagttcttctctgactgattgattgattgattactaaaacactcagcgctcctggcaaagcagttctcactctgttgaacaaattatctttatgcactgcagtctcttgagcttagatgaaggcaagctcactgtaatcttcagatcatttaggcaatgtcttgggaatcactggatatgacaaaatatccagggcatgtgggaatagggaagggggaagaaaagcaggacttggagggactatgctagtggatttcaactc

SEQ ID NO: 49940 - DNA, 1089 bp, Homo sapiens
ctaatcaaggttcttcactatttcagtgctttggattcctttggtaataaggacagattcattctcagaatgttattaaatgcataaaatacctatgattacaaagacaaccaattatatcaaaatacagttaccaaaatattttttaaatttttgaaatgtgctgctttattttaatgtatttaggaataaaatccagtggttaataactataattttgaagtaaagttgaatgtaattgatatattaagggatactaagaatgatataaaaattgggaatttttatttttgacagtcataggccctattaaactaatgaagtaagtttgttgcctccaatcagagtgaaagagaatgttaaatttcagttagaggttagtaaatataaaggtaatttctttactgtgcgatgtcacagactaaagtttatattgtatttgaatgtggctaggaaagtagataatatgcagcctatatcttggggcgccatttcctaaattagatttgcagcagcaggtacatcaagccattctttcttgattaccttcccatgtggtctacttgattggtccaaatgtaccaaatgaaatatacttcctatatgtagaaggaaaatttgggagaagttgtaaaatcgtgacagttttgacattcacgtgaaattggttaaaattaaaatataaggtacatcttttaaatgagtagactgaaaatgagccagtttgtcataaacttacccatcatatctacgttttaccttatccatatcttgtttcacttggttctatctcattctttttcactgaaattatacgtaggcttatttttccccatgcccaaaaagggaatattttaattctgaatttattccacaaaactttacatcactaaatgtgtgtttataggacgcatataaatttgtatgaaatttaaatatgattattttgattgcttacatataaagctgagtaaacatggcataaaattatatttcccttttggctaatgttctttcattaattggttctttgaggcagcggtagctgtgcaagtggcagtattgaaatattctcagtgattctgtcat

SEQ ID NO: 49941 - DNA, 368 bp, Homo sapiens
atggttacctaagaagccaatgaggctggacaaggagacactgccagacctggaggagaatgactgctacactgcccctttcagccagcaaaggatccatcagtgagtgttccatgttaaagccccatctcactaaggatgtgcagctgtggtagagcctcaccctgcacgcctttgattcctgggcatgaggaaggaacagcatagtgcccttctcccctaaaagtcttgtgagtgttcatatcccttttatttcagtcaggggaagataactgctgtaaccaacaatccctgcatctcagtggcttaagatgatacaatgcttgctcatgtgtgtgttgggtaaatgatcttctccacagaaaggc

SEQ ID NO: 49942 - DNA, 280 bp, Homo sapiens
ccagaatccaactggcctgtgcactgagaggattgcatactggggtggagccaaagtttattatacatctgcccaaactcacagaatgtacaagagtgaaccctgacatgaactatggactctgggtgattatgatgattcagtgtgggttcaccaattgttcaccactctggtggcagacaatgaaaacgggaggttgggcatgtgcaggagcaggaggtttatgggaaatctctgtgaagattattttcttcttcattttgctgtgagcctgaaattg

SEQ ID NO: 49943 - DNA, 277 bp, Homo sapiens
aattcaccttgttcgcagaattatcctgttcacagatgatatgatcttatatatagaaacccctaaatactccaacaaaaaacttctagaactgatacattcagtaaagttacaggatacaaaatcaacacgttaaaatcattttagcatctctatgcaccaataacaatcagagaatcaaataagtcaattccatttaccatagctacaaagatctaaatcgtagatctaagaaggtttaaattttgattccttgcttgcactcctagcaggtaaa

SEQ ID NO: 49944 - DNA, 158 bp, Homo sapiens
acaggctgtgctaagtgttaactagcgcacatccacagggcgatgggatatgaccatagcgaggtaaagttagcaagcaagggaagtcaagaaaacgacctgtgagcaacctgccattccagatggctggaaaagtgtgcaaagaggacagaacagca

SEQ ID NO: 49945 - DNA, 435 bp, Homo sapiens
aacattttaatctatctttggaatatttaagcaaatattaaaatatgtggttacctaacatggctatatattaaaatataaatgttatattaccctgtaacattttaaatgatttactaatctattatgtaaagtaatataagaagccagtttagtggtagaaatgttaattttattttaactttagtatttcaaaacaaagatgttatttttgaactcaaagtggtagaagcagagaggaggtgacaaactgagaaccttttgattttgttggggtggaacttggtctgctgttatagctgacattattactgtatctcaatgatttttgagattttggggaaaattgttttaatgtttcactcccaagcgctggaagatactccagaaatctttgccgttctgttcctataacatttgctcttccattttgaa

SEQ ID NO: 49946 - DNA, 399 bp, Homo sapiens
ggatcccagcggcggtcctgtagctgagcaggcctggggcttggttctatgtccctgtggctatgtttccagtgtcctctgggtgtttccaagagcggcaagaaacgaataaatctctggtgagttgtttatttgttcttcactttgttttacactgtattttctgagtttatgggtgtctgtgaattaaaaaggaaaagtggaaataagtaaaactcaggttgaaggaaatatacataaataagataaagctgacctgtagatatagacaggttataaaagcttgagttgctaagtgagtgcaaagtttcctctgatctttctgatgccgaaacaaaaaaggcagtcatgtttgttacgtgattggaatggaacccgaaaagagagcatgctgtgttc

SEQ ID NO: 49947 - DNA, 352 bp, Homo sapiens
  misc_feature (328)..(328): n is a, c, g, or t
ggatcccagcggcggtcctgtagctgagcaggcctggggcttggttctatgtccctgtggctatgtttccagtgtcctctgggtgtttccaagagcggcaagaaacgaataaatctctggtcctggtgtagagaagtccctcaacctattgtgcaagagttttgagaagcggccccgcagcgcctccaccccagagacccggaccaagttcacacaggacaatctgtgccacgcccagcgcgagcgccctggactcggccaacctgtgggtgcttgtggactgcatccttcgcgacacctccgaggacctgggacttcagtgtgacgncatgaacctggccttcgggcgccg

SEQ ID NO: 49948 - DNA, 1060 bp, Homo sapiens
gtggcacaatttcggctcactgaagcctccacctcctgggttcatgccattctccttcctcagcctcctgacacattttgttctttagacctgtttttgtatctatcagtagtgaacgaaggtgcctgtgttgccatcccctcaccagcactagattctttttttctcctgtcattgccaggttcttagacaattactgatatgccattttagtttttcactttggttattagcaagtttgaaagttacatgataaaaagtatcttttctcttttgaattgcttattctttagcctgttattctgtttgggagtttaacctatttctggttaatttataagagcaatttatttaaaataatatattattaaatatattataaaaagcaacaaaatatgtattataagaattaatgatatagaaatctgtgacacaaaataactctcctataatcccactttaaccactgttacaaatttggtgcatattcctgaaagatccttatatagtgaggaatttttaccattgcttatcaaatatgttgtaaatatattgcctaacttttaattttacccttaacattttttctattattttaatagttaatacatgtacctaatacaattcaaaatataaaagattatgcaatataaagtaaatttttaaaaatttaggttgactttatcattatagaaaaatctaggaaaaaacaaggaaggaaaaagaaatcattctcaactcaccattcagaaacagcattttgggccaggcatgggggctcgcacctgtaatctcagcactttgggaggccaaggtgagggagtcatttgattctaggagttcaagatcagctctggaaacatataccccatctctacaaaaaaaaaaaaaaaaaaaaaattagccaggtatagtagcatacacctgtggtactagctactcaggaggctggggtggggagatctcttgagcctgggaggccaaggcaatggtgacctgtggttggaccactgcaccttagtctggggaactgagtgagatcctgtctcgaagaaaaaag

SEQ ID NO: 49949 - DNA, 568 bp, Homo sapiens
ttcccgtctatgttaaaagctttataaatttttaaagaacacagaccccgtgacgcatgttgctgtcaaatcaggaaattgcttcaggaaggccttgttctgctgttcggcggctgtgtgtcactgacttggtttatttaatagttcttctctttaattacatctgtgtataattgccttgtacgttccagggagtgtgtttattgttcggattcctgatgactcatcggtgtttttggcatgctcacaggtcaggccttagttatgggaaaggcccagtggatggggaagcttccaagggaccgtgatgcctttgtggaagtggctaaggagagttgagagagctgggctaaggcgagttgctgcagcacagtgggacgaaggtggagcaaggaatggctgcatccttcccctggggatggatgtagtggggaagagaaccacccttgagacagatctggaagtgctttgctagtcagccatgggacgagtctcactctcgcccaggctggagtgcagcggtgtgatcttggctcactgtaacctccacctcctgggttcaaacaat

SEQ ID NO: 49950 - DNA, 449 bp, Homo sapiens
ttcccgtctatgttaaaagctttataaatttttaaagaacacagaccccgtgacgcatgttgctgtcaaatcaggaaattgcttcaggaaggccttgttctgctgttcggcggctgtgtgtcactgacttggtttatttaatagttcttctctttaattacatctgtgtataattgccttgtacgttccagggagtgtgtttattgttcggattcctgatgactcatcggtgtttttggcatgctcacaggtcaggccttagttatgggaaaggcccagtggatggggaagcttccaagggaccgtgatgcacctgtggtactagctactcaggaggctggggtggggagatctcttgagcctgggaggccaaggcaatggtgacctgtggttggaccactgcaccttagtctggggaactgagtgagatcctgtctcgaagaaaaaag

SEQ ID NO: 49951 - DNA, 239 bp, Homo sapiens
attctagtaataattttttatttggttttttttgtgaatcagtttttggtaataataatgttaagttctgataaaacagtggttctcaatcctggatgcatatcagaatcacatacatatggatctttaaaaaataggattcttgggccacatcctgagatattctcatttaattatcccgaggaggtggagtgcggtggctcaggcctataattccagcacttcaggaggctgagggg

SEQ ID NO: 49952 - DNA, 845 bp, Homo sapiens
atagaattgttttccaaagtgcccccgtctgccctatttccaaataacaaatttagcaaatatgaatgaaaccttaatttttgtgaatagtatgaaatcacagcataagtgttcacgtttttctttcttgtgtctaaaggatctctcttacaatggaagttgacaggaatattataaatattataaatgtctttgttgcataactttcaaatttctggtcgtgaatagttttcagcttttaggtctgttatttgagttttgtaggtgtactttgagcttgatcaggtacagtggaaatgttacatgttatgttttagttatgactacctggaagatggggaaagatacacctcttaaaattgatttaggaaagaaacgccaatttagtatctgggaaaggacacaacacatttttaaaaatgtgtagtgcttcccattaagcttaacgtaaaacttttaagcattgagaattgttaccataaatatagtttcttgagaataagttgctctcttttatgtttcagccagaaagtccatgtatatacagattacagcaggtccttgaataatgttgtttcaagataatgttgagaaaaaaaactgtctgtggagtttacacgttctccctatccctgcatgggttttctctgggtactcttgatttcctcccacatcccaaagctgtgcacgtgaggttcactggtgtgtggagctgtgtgtgtaagtgtgagtgctttctgcagtggatgtcctgtccaggactggttccggccttgcaccctaagctgctgagataggctccagccaccccaaccctgaactggaataagtggtaaaaaaaaaaa

SEQ ID NO: 49953 - DNA, 448 bp, Homo sapiens
ttctgaagttacagttataaatgtattctgatttcaatggtatgatgtcttgcaattttatttagaaagtataatttgactactctagccatattatttttagaaaagttgaggtcctttttcaaaatatgttttgaagatggaaattcaaaatattagggtcttaaaatagaatcacatatgaacctgtgtggtgaacattaacccattggtagtctcaacttgagactgcatttgaactacacttgtgagtgatttttcttagctttttgagatagccagggctttctgtataagtgctaacatactcctttggtgacctccattattcccagattatgcatctttcctacacttgcattttcagttggggatagaatagtgagtggagttacggtccagctctgacttaggactatgttacatctttctcatgcctgaattcacc

SEQ ID NO: 49954 - DNA, 317 bp, Homo sapiens
gaggaagaagccagttttttccaaaagagtataattagtatgatttcaactatgtatgatttatgatggcatgtatcagaactactgggtggtgactatgtgcgactttctgacgcgctgagagagggcgtcttccaagatgcaggcagcaaggtattactactttatctgggtaggagataaacatggatacatactgtaaacatggattatgtttacttcataaaaatttctcactctatatgtatgatttgtgtacttttccccatgtacattaaacttcaatcatatatttaaattttaaaaaatattacact

SEQ ID NO: 49955 - DNA, 378 bp, Homo sapiens
aatttaggtacatcatgactttgttgcttacaattcaaattcatatataatctagaaaaataatttgaatcctgagtttaacccacctgctttaaagagactgttgttcaaaaattgcttcttagttattgatactagatgtcttaggggctttgggccttagagggtctgcaaagctctgacactaggttctagattttatagataacttcatatattttctgggaaagaagggctgtgaccactaaagtagtttaccactgttttctagaaagacttaaggcaactgacctgttcatatgtcactcttctgctgccgctgctccctggcactcccacagtattaggtcctaagagactatcattgtggaggtggag

SEQ ID NO: 49956 - DNA, 446 bp, Homo sapiens
gcatgctcacttttatctgagacatcttctcttcctggaatgacctgggatcccactttaggcatgttggcagcaataagaaattcagcctgagcctgactttcacagactcatttggtcccagttttctgtgtccaggcaactcacccagtgttttctgccaccctggcaaactggctgccagcacatcacactacgtatgtttgtgggttcatatgtgtccacgtgcagaatctgcccatttcctggatcatcctgggccatctggggaagcctttttaattttttcttttgcctcctgcctttcaagcttctcttttgattcttgtggcttgtagtccaacaagagtagaaggaaagagcttcaggaagtgaggagtttattaaaattcctttgaagcatttcaattcagtaagaggaactatcttttctgttagctaagaca

SEQ ID NO: 49957 - DNA, 859 bp, Homo sapiens
ctgtctagacaccttttccttagaaaacatcctgaaacataagaataagcacaaaaatgaacatattacatcaaacgtacccactgagaagaatgataagtttaacagtttcccacgtgggaggcatattgacgattacaattttaagttagcagaacaccagctcacatggaaacagtctcctccgtgaattctttctttggctgacagacatgagatgttagctgtctaagaagaccttcacaccaacaccttcttagaagatattgtaagataacaatccttgagtggaacctgaattctttctaaacactgcatgtaggaaaacaagaggcagttcacacaatcacttaacacctcttcttaaaagtgaatccttgaaggagtggtgttcaaatatttaagtacattagatactttatacacgccacatccaaaatgctcagtattcctaatacatttcattttctcccaagttttaatggttgatgcacaatcacattaatttcctattaatttctaggaatatgtacacagtagccttaggagaaagaagataactattactttacatttttaactgttttgttttcatgtccatgagagaaaaattaaagtaagttaaaaaattaactcagacactctatttatttttaggaagacatacaccccccacagggagacttttacatgttgtaataatgttcacaaacagctactctttaagtgtaacactattctaagcctcttttcctccattttatttcatatacatttatgcatctgcatgcatatataaccacatgtatttatatttagtaggtatagtttattacacataaatctaaatatctatcat

SEQ ID NO: 49958 - DNA, 760 bp, Homo sapiens
attttttttgttgttgtttttatttctgcatacagattacaattttaagttagcagaacaccagctcacatggaaacagtctcctccgtgaattctttctttggctgacagacatgagatgttagctgtctaagaagaccttcacaccaacaccttcttagaagatattgtaagataacaatccttgagtggaacctgaattctttctaaacactgcatgtaggaaaacaagaggcagttcacacaatcacttaacacctcttcttaaaagtgaatccttgaaggagtggtgttcaaatatttaagtacattagatactttatacacgccacatccaaaatgctcagtattcctaatacatttcattttctcccaagttttaatggttgatgcacaatcacattaatttcctattaatttctaggaatatgtacacagtagccttaggagaaagaagataactattactttacatttttaactgttttgttttcatgtccatgagagaaaaattaaagtaagttaaaaaattaactcagacactctatttatttttaggaagacatacaccccccacagggagacttttacatgttgtaataatgttcacaaacagctactctttaagtgtaacactattctaagcctcttttcctccattttatttcatatacatttatgcatctgcatgcatatataaccacatgtatttatatttagtaggtatagtttattacacataaatctaaatatctatcat

SEQ ID NO: 49959 - DNA, 667 bp, Homo sapiens
ggatcatgggcattaagttagtgatgatgaatagtagatttaatgtagtaggatttgtaattattttccttgggtcaggaaatttattttggggaactaattctagcaggtaaactttgtttctccttcctttaagtatcttacccaaatccttgagcagtgcttctgtggaaaatgagctggttgctactgtgtagtagtgaggtctgccataaagactacttcttaaaatagtatcctagtatgtactttcatcacctcagttgtcttgggcctaagtacccatttattttccaaaggaatggacagtttttctagttggagccatctcctgagctccatctcctgagctgtttatcactttcttcccattgtctgtcagacaggtataggcaattgtccaagggcacatactttgttctggaaatctaacacacagcacagtgagatgacacatgcagactcacaagtgtggtcatatcatttcacaagaaagtgctaaacagctttggatgaggttcagactatggtatctgaattggagaaaagaaatgggagtaagtgtgtgtctcctgccactcttctttcttaataggtcagagacatttattcaaggtgtccagtaggcaggaacatagcagttgagatttgctttcgaggcatatgc

SEQ ID NO: 49960 - DNA, 454 bp, Homo sapiens
atagggcaaaatgagtcacgctgtgaacaaaacattctgtatcatttttgttcgcccacctctcccatgttcaaaggccttctgtggttccccattgccttcacattcaattccaagcttttgaatctgtctctcaagatccttctcaaacttatcctgcatcactccccagtgtgggctggcccactccaatgccatcccaaatacccacactcattctctcctctctcccttggctccagctgtcttctacctgggagaattctccctcttcctttctacaaaccaaaatctcactagttcaaaggcaaattcaagaccactgtgccctctgaaaactcctccggccccaccagccccactgatttctgcatttcagatgcactgcctaggattctgaggcctaaatctttcccgccagtcccaaactgccattgtaaattcctgttgactt

SEQ ID NO: 49961 - DNA, 315 bp, Homo sapiens
aagattttgtaagagtagttaatgtgtgttctgtatttctttacctccccttgtgtctgagcccctttgtcttgcctctaatactccctttaaattgtttaacagtgatctgtaacacgtcattgtcaaatgcagtagactcttttgggaccttattttagtctacctctctatgaatatgtgaaactctttattgtttccctccattggcttgcattctcagacttcccctcagtctgtactctttccttgggggaccttacctacactcaggtcatcagctaccgctctgtgaaaataagtcccatttttttt

SEQ ID NO: 49962 - DNA, 2001 bp, Homo sapiens
acaatcctttgcggtggttcaagatggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtagggtactatgtttggggagactggctgaggggcgtgggatcttcccctggagcctgagaggatggatggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaa

SEQ ID NO: 49963 - DNA, 1930 bp, Homo sapiens
acaatcctttgcggtggttcaagatggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaa

SEQ ID NO: 49964 - DNA, 362 bp, Homo sapiens
gcgactactactactactacaactaaattggcggccggtacgacgccactgcattctagcctgagtggcagagtgagaacctgtctcaaacaaaaacaaaaattgttccttgatctcaccatcctctcacatggtactggttagtgcatcttatgctcacttagcaattgagagaatttgttctctagttctttgactgtacctatttaggtgtgtctttattggttttagaagttaattttggccaggcgcagtagctcacgcctataatcccagcactttgggaggctgaatcacaaggtcaagagttcaagaccatctcctggccaacgtggtgaaaccccgtctctactacaaataca

SEQ ID NO: 49965 - DNA, 223 bp, Homo sapiens
ctcctcactctgctcctacacaaacacattgccctgtgttcatccgtgtctatcacatactaccctgtttcccacaggacatccatccccttccccctcactcaccccgatttccttatattagagttctttgttgccagggctccctgaacatgctccacctccattaggaatctaggaatcggtgaccccatagcagtgggtctcacactggagtgtgcct

SEQ ID NO: 49966 - DNA, 350 bp, Homo sapiens
tgaaatgtaccctgtataattcatttatggtcattattggtcctataaagggatatctaacaagttaaacaatgaggttatttatctggaggagaggcacagaatgcttaaatcaagagagaaaaaagcccacagaatcacattatagctactctattttgttaaaaaatacaaataaaaaataaaaataaaaaaaggtggggggacagtctaatgagctagattttaggagtaccaagagaaggaaacagctgcttcaaccatcacctcgtaatcaggaaaattatgatttaaaatccttttgattcttttcagatatataatgattattctgaagccctcaaatacag

SEQ ID NO: 49967 - DNA, 973 bp, Homo sapiens
agacttataaactcacttttaaataatttatggatcaaagaagaaatcatactgaagacaggttgaaaattgatgaactaagcatcttactcaaaaaactggaaaaaagtaaaaggataaacccgatgaaagtagatgtatggaaatgataagtgtaaaagcataaaattgatgatgtcaaaaatgaaaatataatagaggatttttaaaagcctgctctttgaaaaaagctaattgaataggcaattctctggcaagattcatcaagagaaaaaagacataaataactaatatcagcaataaaaaggagacaacaatatagaagaagatgatagatgagctttatccctatatacttgaaaactttgatgaaatagccagtttactaaaaaaatacaccttagcaaaactggccaaggaagaaatagaaaacctgaaatagacctattactaggactaatatttagccaatatgtactggttcagctgaagtactgttaaaagattgaacttcttccataccaattcgtaaataggcactgccctgagttaccctctgacaccctctgactacccaggcccctcttctagagatacctcccacaaaaccttcccatgattcagcagcaaaagtcccccttacacaatatggcgattccaggaccctgttccagcacagccatctgcatctattctgactggcaagtgttcatgcggtgcttgttatttaaatattctgaatatcacctctgccacagccattaaagaaatggaaaaaatgagttaaaaactacctacagtactaataaaagagcaggtctgtcagttttacaggtgacttctaccaaatattgcaaataagagagaacattctaattttattaaactgatcagattattgaaaaagggaattcttacatcatgtataaaattagtatgaccttgatacccgaacttaacaaagataatatta

SEQ ID NO: 49968 - DNA, 375 bp, Homo sapiens
taaaattaatgattttctatttaaacacagagtcaagcaaagcaagtttctctgcaaggaaatgccctacttccatacattcaagatctgaataatagatatagaagctacagagtattttcatttccagagagataagacatataaaattctgactcacagctcttcttttggaaggattcatcaatgatatatatctgacattttgtactcattcttttttttaaattatactttaagttctgggatacatgtgcaggggtgggatctgctgagctagatcacttggctccctggcttcagccccctttccaggggagtgaacggttctgtcccactggtgttccaggcaccacttggatatgaaaaaaaaaa

SEQ ID NO: 49969 - DNA, 738 bp, Homo sapiens
gcaggccccgaacaagagtaggtcttgatgctctagcagatcacttcctccagccagtgtggtatagagaggaggctactgagggcctcactaatacacaggaggaggccaggacagaactattggtctcaattctttcatacagtggtgcaggtaagctggttcccttctgttcttaaagaactctgtgggctctggaaggagaccagagcaaatataagagccattaccaaacaatggagacaggatctcaggctagagtgcagtgtcatgatcacagctcactgcagcctcagcctcccaggctcaagcaatcctcccatctcagcctcctgagtagctgggactacaggtgtgtgccaccatgcctggctaatttttgtattttttgtagagatgaggactcactttgttgctcaggctggtcttgaactcctggactcaggcagtccttctgccacagcctcccaaagcactgggattacaggtgtaagccactgcgcctggccttccttccagaattcttatatgtatgttggatttactgaatctctctcactcattgcttttatcttctttatcatcagtcattcctttattctttttctctgagttctggaaaaatgttgtgagcttgttttataagcttccatttcctatggtatcactttgtatttctattgcattttaaaacacacattttgcatgtgtatgcatgcttatgtacacatgtatacg

SEQ ID NO: 49970 - DNA, 1429 bp, Homo sapiens
  misc_feature (1179)..(1179): n is a, c, g, or t
agcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggcccacccagccgacatgttttctttggcctgggtggtttataccctgagccaacctttaaaaattggtagatttcacataaaagtccagatccacagttctcttgaagaatgaccacctggtacgccggtcttcggtggcaacactaccttgggacactgctcccagtcacaagggcccagtgnccgtctctcactagtgcgcctgacccttgtacactaggagctggctcccacctctgcagggttatttcctgcacctcgaggccgctgcgggcaatctggagtgaaacacggggacctgaaggatggagaggctgggacccccgcttttgaaagagggtgcagcctgggaaagggcgggccttgcttggggactgcggttggaagtagagttcccaggaaaaggtctgaaggggttggattgggggtcaag

SEQ ID NO: 49971 - DNA, 2119 bp, Homo sapiens
  misc_feature (1869)..(1869): n is a, c, g, or t
agcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggccgccagaggccatggccacatgcctggcctacacaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccaggggactaggaagggcgcagctcagagggtgcaggccaagtggggtgggaggtgctgtgtggagggtcccgccccgttccctggccccccagtgctgggacgcaccttttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggcccacccagccgacatgttttctttggcctgggtggtttataccctgagccaacctttaaaaattggtagatttcacataaaagtccagatccacagttctcttgaagaatgaccacctggtacgccggtcttcggtggcaacactaccttgggacactgctcccagtcacaagggcccagtgnccgtctctcactagtgcgcctgacccttgtacactaggagctggctcccacctctgcagggttatttcctgcacctcgaggccgctgcgggcaatctggagtgaaacacggggacctgaaggatggagaggctgggacccccgcttttgaaagagggtgcagcctgggaaagggcgggccttgcttggggactgcggttggaagtagagttcccaggaaaaggtctgaaggggttggattgggggtcaag

SEQ ID NO: 49972 - DNA, 1075 bp, Homo sapiens
agcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactgagcaaatggaatgatgactattgataccactagcttacgcccgtcccgaagcaggcgcgagcta

SEQ ID NO: 49973 - DNA, 1504 bp, Homo sapiens
agcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggtgagtggggctgggggaggagagtaaagggactttccagtgcacagactctggagaaacctccccacatgggccccgctccgctctgccctgctctgggggcgtggatgctgggggacgtcattttacatgggtggcactgaggcctgttggggcgcggctgctttccctgttcagcaagacctgtcttttttatcgtagtgagatggaaacagcaggaccctggggcacagggatggggactggcctggaggcctccctgcaccctatacctctacataaacacagccgcagccattgtctgctcctggccagcttgaaggttggccaggctgtcactctcagttatggttgtatgtgacgggggttgcctgggtcattgccagccagcaccccactgggccaccgttgcagggtagcagggagtggggacctctgtccctttacgactttcttcagggcagaaacctctcctgatgatgtttcttcagtcatagtccatctgggatgccaaggaccaggtttctccccattcttataacacaccagcaggcaggattcctgaacggaggcaggtccaggttggcgattgcagccacgcattccagcgtctgggaaagaggcacgtggggccaggtgtggtggctcatgggaggatcatttgagtccaagagtttgagaccagctggggcggcacagtgagacctcgtgtctacaaaa

SEQ ID NO: 49974 - DNA, 1598 bp, Homo sapiens
  misc_feature (1348)..(1348): n is a, c, g, or t
cgaggatcttcaccacggcaggtgtactcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggccgccagaggccatggccacatgcctggcctacacaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccaggggactaggaagggcgcagctcagagggtgcaggccaagtggggtgggaggtgctgtgtggagggtcccgccccgttccctggccccccagtgctgggacgcaccttttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggcccacccagccgacatgttttctttggcctgggtggtttataccctgagccaacctttaaaaattggtagatttcacataaaagtccagatccacagttctcttgaagaatgaccacctggtacgccggtcttcggtggcaacactaccttgggacactgctcccagtcacaagggcccagtgnccgtctctcactagtgcgcctgacccttgtacactaggagctggctcccacctctgcagggttatttcctgcacctcgaggccgctgcgggcaatctggagtgaaacacggggacctgaaggatggagaggctgggacccccgcttttgaaagagggtgcagcctgggaaagggcgggccttgcttggggactgcggttggaagtagagttcccaggaaaaggtctgaaggggttggattgggggtcaag

SEQ ID NO: 49975 - DNA, 468 bp, Homo sapiens
ctggcaacagggatcctggcctttgtcttcaaggactggattcgagaccagctcaacctcttcatcaacaacaacgtcaaggcctaccgggacgacattgacctccagaacctcattgactttgctcaggaatacgtgagtccagtgtccagcctgggacacctgtaggaggcgccttcctggcagacgaatgagggagcaagttccctgtgatgggaccatctccttacccacctgggctagcgggccccaggagagagacccaggagtgtcctcgtccgaggagagccagcccctgctgatccttatgggtccccatttgcctagtgccatagggccacggccttgggaaacagagggcatgggctccacgctagcagctcccaggccagggcctacgacacacgggagaatggaggaaatgtgacataaaatatagatttctacttctgctaaaccttgggccca

SEQ ID NO: 49976 - DNA, 1555 bp, Homo sapiens
  misc_feature (1305)..(1305): n is a, c, g, or t
agcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggcccacccagccgacatgttttctttggcctgggtggtttataccctgagccaacctttaaaaattggtagatttcacataaaagtccagatccacagttctcttgaagaatgaccacctggtacgccggtcttcggtggcaacactaccttgggacactgctcccagtcacaagggcccagtgnccgtctctcactagtgcgcctgacccttgtacactaggagctggctcccacctctgcagggttatttcctgcacctcgaggccgctgcgggcaatctggagtgaaacacggggacctgaaggatggagaggctgggacccccgcttttgaaagagggtgcagcctgggaaagggcgggccttgcttggggactgcggttggaagtagagttcccaggaaaaggtctgaaggggttggattgggggtcaag

SEQ ID NO: 49977 - DNA, 1523 bp, Homo sapiens
  misc_feature (1273)..(1273): n is a, c, g, or t
agcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgagcaaatggaatgatgactttgaaaaccactggcttacgcccaccatttccgaggtcctgtccacggcggggcctcagcagaactctctgactggggcccctggcccggcccacccagccgacatgttttctttggcctgggtggtttataccctgagccaacctttaaaaattggtagatttcacataaaagtccagatccacagttctcttgaagaatgaccacctggtacgccggtcttcggtggcaacactaccttgggacactgctcccagtcacaagggcccagtgnccgtctctcactagtgcgcctgacccttgtacactaggagctggctcccacctctgcagggttatttcctgcacctcgaggccgctgcgggcaatctggagtgaaacacggggacctgaaggatggagaggctgggacccccgcttttgaaagagggtgcagcctgggaaagggcgggccttgcttggggactgcggttggaagtagagttcccaggaaaaggtctgaaggggttggattgggggtcaag

SEQ ID NO: 49978 - DNA, 1396 bp, Homo sapiens
  misc_feature (1146)..(1146): n is a, c, g, or t
aggtagaggccggggttaatcggccgagggtgcccttctcctctgcgtcaggaaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggccgccagaggccatggccacatgcctggcctacacaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccaggggactaggaagggcgcagctcagagggtgcaggccaagtggggtgggaggtgctgtgtggagggtcccgccccgttccctggccccccagtgctgggacgcaccttttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggcccacccagccgacatgttttctttggcctgggtggtttataccctgagccaacctttaaaaattggtagatttcacataaaagtccagatccacagttctcttgaagaatgaccacctggtacgccggtcttcggtggcaacactaccttgggacactgctcccagtcacaagggcccagtgnccgtctctcactagtgcgcctgacccttgtacactaggagctggctcccacctctgcagggttatttcctgcacctcgaggccgctgcgggcaatctggagtgaaacacggggacctgaaggatggagaggctgggacccccgcttttgaaagagggtgcagcctgggaaagggcgggccttgcttggggactgcggttggaagtagagttcccaggaaaaggtctgaaggggttggattgggggtcaag

SEQ ID NO: 49979 - DNA, 5307 bp, Homo sapiens
atgcgctctccagcgcgctctccaggagctttggctcggtgggtactgtcgcggaggcttgtcattctgacccggggattcctcacagcgtctggcagaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcagatgatgaaatgtttacatcattccagtaatgtcattgattttcatctttccctgtccttgctgtaatacttttaaattatttggccaaaagctttgtattatgatctcttggtctgtgtagttgtggctgaaaataatgagaagctctacgagttatcatcccctttttttgttagaaacaaagggcttgtcaggtctatttgaaaaacctcatagtcatgtgataagcaacaatagatgtttaatgatttcactgttatagcagaagacaagagaagacgcttggcctctgtacatgaaatatgggctcctgatggacctcattcaattctgtactgtgatttccatgccgaacaactcaagccttaaagagagaaatcatggacaactgatttctgcctgttttcaggcaggcacagtttatggcgtcagtgctaggctggaattagaaagtgggggtctatgacgtggacttcctgactctttgatctctttgttgttgaccaacacttgatcctactagttacttaatttttttaagtaaaaaattattattattttgtttctgcaaagattttctcaaagccatagaggagcatttctcagaatatgttctatgatatgtgtcacctaaaaaagtaagagattccaaggtcaggttgatatggaaactctaggttaaataaagttaagcatttctttatgaaagaacttctggaaacttccatgtgataatgtgcattgcggatctctaggaaggaaatgatagtgtatagtattttctaaatacttgtgattcctaaagttctcttacaaggagccctttgtaggaccagtgttcttagtagcgcgctttgggcagtgtggctgtgtagtgcatagctacctctgcaaggtgataactaagccggcaagctgcctttcaacactcatgcagtcacgttgtccacctgagattctcaacagggtataaaaggaaggtctcatcttgcctcacaggaagagtgggctcagtgtggcttttttccaactatggagaaactcagtgctcatctactttaagtttccacatatggcttgctcatagccttggtccttacctttcctgccataactttctagaagagcttaatgggattttttttctaaaaaatgtaaatatgcagttaggcattattttatgtaaatgcattgggtttttactgtagcatttggcactaaatggctttgggggtgatgaggtggggaaggatacagcaggtggtacagtagtcaggaagtacctgccaccaatgagatgtctgatgctttgcctcttaccatgcctctgaatgtctttggatccaacccagatgagactgaaaaaaaaaaaacagtgtaactaagtggcatctgtaaacagaataaatgaaaatgtcacctgaaaaaaaaaaaaaaaaaagaaacaaaacaaacaacacaacaaaacaaacacaaaaaaacaaacagcaaacccaaaaagagacaagaaagaaactacagcaacgaagaaacaaaaagatagaggcgaaaatgaacagagcacaaaagcacacaaggcacggagacgccagagagagcacgcaacaaagacaatcagacggcgagcgcgcggggagcgagacagaaatagcgcgagaaaggagaaggggcgcagaccacgccaacgtaagacgcataggcatcgaggacacaaaaacacgaggcagacgagaatagcgagctaggagacagggccgaggctggacaacaacctgagccgcaccgacgcccaccaaggaacatgcgctaccacgcgaacgactggacacacggtgagagtcggagacggaggcaatacaccacaacggactggaagagacgacaagaacagtaatatcaagcgaatgcgcacgtcgagccgaccacacgacagacacccggtcaggacgagttaccgaatggagtagaacattcgggagaggagatatgcgg

SEQ ID NO: 49980 - DNA, 5203 bp, Homo sapiens
tggaagctcgggtgaataaatatccagagtaaatgcttgggcctgttacgtttatctggaagtcccagaggaccaccgaggtgagccgttctgagcagcaggcagctgtggatctggctgcatccaacccttaaacagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcagatgatgaaatgtttacatcattccagtaatgtcattgattttcatctttccctgtccttgctgtaatacttttaaattatttggccaaaagctttgtattatgatctcttggtctgtgtagttgtggctgaaaataatgagaagctctacgagttatcatcccctttttttgttagaaacaaagggcttgtcaggtctatttgaaaaacctcatagtcatgtgataagcaacaatagatgtttaatgatttcactgttatagcagaagacaagagaagacgcttggcctctgtacatgaaatatgggctcctgatggacctcattcaattctgtactgtgatttccatgccgaacaactcaagccttaaagagagaaatcatggacaactgatttctgcctgttttcaggcaggcacagtttatggcgtcagtgctaggctggaattagaaagtgggggtctatgacgtggacttcctgactctttgatctctttgttgttgaccaacacttgatcctactagttacttaatttttttaagtaaaaaattattattattttgtttctgcaaagattttctcaaagccatagaggagcatttctcagaatatgttctatgatatgtgtcacctaaaaaagtaagagattccaaggtcaggttgatatggaaactctaggttaaataaagttaagcatttctttatgaaagaacttctggaaacttccatgtgataatgtgcattgcggatctctaggaaggaaatgatagtgtatagtattttctaaatacttgtgattcctaaagttctcttacaaggagccctttgtaggaccagtgttcttagtagcgcgctttgggcagtgtggctgtgtagtgcatagctacctctgcaaggtgataactaagccggcaagctgcctttcaacactcatgcagtcacgttgtccacctgagattctcaacagggtataaaaggaaggtctcatcttgcctcacaggaagagtgggctcagtgtggcttttttccaactatggagaaactcagtgctcatctactttaagtttccacatatggcttgctcatagccttggtccttacctttcctgccataactttctagaagagcttaatgggattttttttctaaaaaatgtaaatatgcagttaggcattattttatgtaaatgcattgggtttttactgtagcatttggcactaaatggctttgggggtgatgaggtggggaaggatacagcaggtggtacagtagtcaggaagtacctgccaccaatgagatgtctgatgctttgcctcttaccatgcctctgaatgtctttggatccaacccagatgagactgaaaaaaaaaaaacagtgtaactaagtggcatctgtaaacagaataaatgaaaatgtcacctgaaaaaaaaaaaaaaaaaagaaacaaaacaaacaacacaacaaaacaaacacaaaaaaacaaacagcaaacccaaaaagagacaagaaagaaactacagcaacgaagaaacaaaaagatagaggcgaaaatgaacagagcacaaaagcacacaaggcacggagacgccagagagagcacgcaacaaagacaatcagacggcgagcgcgcggggagcgagacagaaatagcgcgagaaaggagaaggggcgcagaccacgccaacgtaagacgcataggcatcgaggacacaaaaacacgaggcagacgagaatagcgagctaggagacagggccgaggctggacaacaacctgagccgcaccgacgcccaccaaggaacatgcgctaccacgcgaacgactggacacacggtgagagtcggagacggaggcaatacaccacaacggactggaagagacgacaagaacagtaatatcaagcgaatgcgcacgtcgagccgaccacacgacagacacccggtcaggacgagttaccgaatggagtagaacattcgggagaggagatatgcgg

SEQ ID NO: 49981 - DNA, 4017 bp, Homo sapiens
atgcgctctccagcgcgctctccaggagctttggctcggtgggtactgtcgcggaggcttgtcattctgacccggggattcctcacagcgtctggcagaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcagatgatgaaatgtttacatcattccagtaatgtcattgattttcatctttccctgtccttgctgtaatacttttaaattatttggccaaaagctttgtattatgatctcttggtctgtgtagttgtggctgaaaataatgagaagctctacgagttatcatcccctttttttgttagaaacaaagggcttgtcaggtctatttgaaaaacctcatagtcatgtgataagcaacaatagatgtttaatgatttcactgttatagcagaagacaagagaagacgcttggcctctgtacatgaaatatgggctcctgatggacctcattcaattctgtactgtgatttccatgccgaacaactcaagccttaaagagagaaatcatggacaactgatttctgcctgttttcaggcaggcacagtttatggcgtcagtgctaggctggaattagaaagtgggggtctatgacgtggacttcctgactctttgatctctttgttgttgaccaacacttgatcctactagttacttaatttttttaagtaaaaaattattattattttgtttctgcaaagattttctcaaagccatagaggagcatttctcagaatatgttctatgatatgtgtcacctaaaaaagtaagagattccaaggtcaggttgatatggaaactctaggttaaataaagttaagcatttcttt

SEQ ID NO: 49982 - DNA, 2730 bp, Homo sapiens
atgcgctctccagcgcgctctccaggagctttggctcggtgggtactgtcgcggaggcttgtcattctgacccggggattcctcacagcgtctggcagaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgca

SEQ ID NO: 49983 - DNA, 749 bp, Homo sapiens
atgcgctctccagcgcgctctccaggagctttggctcggtgggtactgtcgcggaggcttgtcattctgacccggggattcctcacagcgtctggcaggttggtcgtgaggggctggtgccttccagggtgcgagtgtcgggggaactgtatgcggcggcccccctcccggcgcccgtctcccctcttcatcgtttctctctcagactccgctgacctctttccttgctgcctgtgcccggggcccctctccctggtgtcgcatctccttcggcccctgcgctggagccccctacgtcagtcatttcccttcattgccccgccgggtggaggccgtcctgggaatgggcttgcatcccctcttctgcaaccccaaatgactaatatgggtcattctggcgaccacgctgagatctgggcgttggtcctcccgtgttccctttcctgctcctcctgtgttcccttctctagggtgctcctcgggctttacaaggtcactgtctgaacagagccctagtgattgggatatcatttcagaaagaaagatggtgatctggaatggcccagatcccttgtaagtattctgctgtgtcagaaggggtggtacttggctaaatatttcttatcctgttaatatttgcattgtaagtacgcttcgtttcttcatttatgcgggcactcatagatatatgagtccctactttgtgtaaggcactctgctagatgctaggaggaatgcaacagttaaaa

SEQ ID NO: 49984 - DNA, 5782 bp, Homo sapiens
atgcgctctccagcgcgctctccaggagctttggctcggtgggtactgtcgcggaggcttgtcattctgacccggggattcctcacagcgtctggcaggttggtcgtgaggggctggtgccttccagggtgcgagtgtcgggggaactgtatgcggcggcccccctcccggcgcccgtctcccctcttcatcgtttctctctcagactccgctgacctctttccttgctgcctgtgcccggggcccctctccctggtgtcgcatctccttcggcccctgcgctggagccccctacgtcagtcatttcccttcattgccccgccgggtggaggccgtcctgggaatgggcttgcatcccctcttctgcaaccccaaatgactaatatgggtcattctggcgaccacgctgagatctgggcgttggtcctcccgtgttccctttcctgctcctcctgtgttcccttctctagggtgctcctcgggctttacaaggtcactgtctgaacagagccctagtgattgggatatcatttcagaaagaaagatggtgatctggaatggcccagatcccttaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcagatgatgaaatgtttacatcattccagtaatgtcattgattttcatctttccctgtccttgctgtaatacttttaaattatttggccaaaagctttgtattatgatctcttggtctgtgtagttgtggctgaaaataatgagaagctctacgagttatcatcccctttttttgttagaaacaaagggcttgtcaggtctatttgaaaaacctcatagtcatgtgataagcaacaatagatgtttaatgatttcactgttatagcagaagacaagagaagacgcttggcctctgtacatgaaatatgggctcctgatggacctcattcaattctgtactgtgatttccatgccgaacaactcaagccttaaagagagaaatcatggacaactgatttctgcctgttttcaggcaggcacagtttatggcgtcagtgctaggctggaattagaaagtgggggtctatgacgtggacttcctgactctttgatctctttgttgttgaccaacacttgatcctactagttacttaatttttttaagtaaaaaattattattattttgtttctgcaaagattttctcaaagccatagaggagcatttctcagaatatgttctatgatatgtgtcacctaaaaaagtaagagattccaaggtcaggttgatatggaaactctaggttaaataaagttaagcatttctttatgaaagaacttctggaaacttccatgtgataatgtgcattgcggatctctaggaaggaaatgatagtgtatagtattttctaaatacttgtgattcctaaagttctcttacaaggagccctttgtaggaccagtgttcttagtagcgcgctttgggcagtgtggctgtgtagtgcatagctacctctgcaaggtgataactaagccggcaagctgcctttcaacactcatgcagtcacgttgtccacctgagattctcaacagggtataaaaggaaggtctcatcttgcctcacaggaagagtgggctcagtgtggcttttttccaactatggagaaactcagtgctcatctactttaagtttccacatatggcttgctcatagccttggtccttacctttcctgccataactttctagaagagcttaatgggattttttttctaaaaaatgtaaatatgcagttaggcattattttatgtaaatgcattgggtttttactgtagcatttggcactaaatggctttgggggtgatgaggtggggaaggatacagcaggtggtacagtagtcaggaagtacctgccaccaatgagatgtctgatgctttgcctcttaccatgcctctgaatgtctttggatccaacccagatgagactgaaaaaaaaaaaacagtgtaactaagtggcatctgtaaacagaataaatgaaaatgtcacctgaaaaaaaaaaaaaaaaaagaaacaaaacaaacaacacaacaaaacaaacacaaaaaaacaaacagcaaacccaaaaagagacaagaaagaaactacagcaacgaagaaacaaaaagatagaggcgaaaatgaacagagcacaaaagcacacaaggcacggagacgccagagagagcacgcaacaaagacaatcagacggcgagcgcgcggggagcgagacagaaatagcgcgagaaaggagaaggggcgcagaccacgccaacgtaagacgcataggcatcgaggacacaaaaacacgaggcagacgagaatagcgagctaggagacagggccgaggctggacaacaacctgagccgcaccgacgcccaccaaggaacatgcgctaccacgcgaacgactggacacacggtgagagtcggagacggaggcaatacaccacaacggactggaagagacgacaagaacagtaatatcaagcgaatgcgcacgtcgagccgaccacacgacagacacccggtcaggacgagttaccgaatggagtagaacattcgggagaggagatatgcgg

SEQ ID NO: 49985 - DNA, 3789 bp, Homo sapiens
atgcgctctccagcgcgctctccaggagctttggctcggtgggtactgtcgcggaggcttgtcattctgacccggggattcctcacagcgtctggcaggttggtcgtgaggggctggtgccttccagggtgcgagtgtcgggggaactgtatgcggcggcccccctcccggcgcccgtctcccctcttcatcgtttctctctcagactccgctgacctctttccttgctgcctgtgcccggggcccctctccctggtgtcgcatctccttcggcccctgcgctggagccccctacgtcagtcatttcccttcattgccccgccgggtggaggccgtcctgggaatgggcttgcatcccctcttctgcaaccccaaatgactaatatgggtcattctggcgaccacgctgagatctgggcgttggtcctcccgtgttccctttcctgctcctcctgtgttcccttctctagggtgctcctcgggctttacaaggtcactgtctgaacagagccctagtgattgggatatcatttcagaaagaaagatggtgatctggaatggcccagatcccttaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgca

SEQ ID NO: 49986 - DNA, 486 bp, Homo sapiens
tctgttttcctgaggttcagcaaagctaaataatttgacttaggtcacaagatgataccggcttgactctacccattacactgcatcttccatggcagagagatcatcaactgctgactttgcttcattcattttccacagttgtttattgagcacctttctctgctccaggctctgggatatcacacccaaaatccataaagatctcattgccctacagcaagagattaaaacaagtaatgtaaatatggtgtaataagtgtaaagaatactggaaggagtacagagggttatctgaatcaaagcaaggatgatgtggggcagggaaggcttctcataagatgtgaggcctagcaggggaactgctgggacaaaagtgtggaggcttgagtggtaagacattgaggggcagagagagagaggagggccttctaggtagagggagttacccagaagttgaagttatgggccagcagttctgaatgg

SEQ ID NO: 49987 - DNA, 352 bp, Homo sapiens
aaaaagattagttgggaatttcagaaatgatgcaaatgaggaattattgacatctgtttgcaacaacatggcagagcatttatgcagagaaacattcccagtgcaggaaacacaaagatagatcaagtagctgtgtcaaagcatgactgagcgcatggtaaagtatgaaaaacactgggagaagaaaaaaaaaacacaagaaagtatgattccagaagtataaacaagttcagattgcctgatgaaatgtgaagatcttagattcttagttttaatgggccaggaaggcagagcataggagacaaagtccagggcttgagcacagtgagatgtgacaataggaattattgca

SEQ ID NO: 49988 - DNA, 364 bp, Homo sapiens
caggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctacc

SEQ ID NO: 49989 - DNA, 1729 bp, Homo sapiens
  misc_feature (228)..(228): n is a, c, g, or t
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaaggtaagagcttcccaggctctccatggccacagctccngagctctccctgccccatgagctcagagcccccagtctgagccacagcacagcccccaggaagcgggtggggtgctgagcggcctccagtgtctgaggactcatttaagagaaggaaaaagggtggacccggtggggagtggccggggctgtccaggcagggccgctgctttgggaggaagaagcccacagtctcggaacacgaggacagcacctcccccaacaccacagccggtgcccagatctgctccatgccccgtaaggcaccgtgtctttggcgacatgtcagccctgggctgtctcagggccccaccatccccaccactgtcccctgcagggaggacattctctgtccttctggccagactgatggtgacagcccaggtcctccccagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttttctgacttctgcatt

SEQ ID NO: 49990 - DNA, 595 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacaggtagggaatgtgcccatcccagacccccctcccaaccccagctgctggccaggctctgctcccccagcccttgtcgtgggaccctccct

SEQ ID NO: 49991 - DNA, 1021 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatggtcttttatgctgcccaaaccgataccttgctggaattacctactgtgggaaaaaaaatttttgttattgccccattccattttccccactcttcgaaaatatgactactatttgtgtttgtgcgcaa

SEQ ID NO: 49992 - DNA, 1271 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttttctgacttctgcatt

SEQ ID NO: 49993 - DNA, 833 bp, Homo sapiens
tgggggtccgcttggcttgggcttggtgggggggtccaagccacttccactctccttcttcagaggcaccccagggtccgacccagccctgcctggggaaggctctgctgggaagccctggggctcaggagacctgggggccagcccagaggagccccgtgggggtctcgtgttaaaattagaaagctgaccggagtggggtggggtccaggacacacgctggccactggttggagacggcggttctgtctttcagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttttctgacttctgcatt

SEQ ID NO: 49994 - DNA, 1298 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttttctgacttctgcatt

SEQ ID NO: 49995 - DNA, 914 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagatcacgaactgtgctcgtggcggatacgatcggccgctgtgtgtgtcacggctgtcccggcgtggcaccgctgtctccccaccgtccgtgacctgccctccgcccctgcttccccccccccccccctcccccccccccccccccccccccccccccccccccccccccccccccgcccccccccccccccccc

SEQ ID NO: 49996 - DNA, 915 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagactgatggtgacagcccaggtcctccccagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacaggtcagtgtgagccccagctgccacctgcaccccaaagattgttccctctcctgagagcagcgtggggcgccaaagccccagaggaaaaccctggtacccgccgcctcctctgcaggctctggaactctcagggtggaagtggcctcggcggggagggaggggga

SEQ ID NO: 49997 - DNA, 434 bp, Homo sapiens
ctgtcctctgtcccacacttacatcatctagctgcctcagagaaggccactaaattgctgttattgatgacaaaagctacattcagtcttagtacaggtagcgtgttcagatagtaagcttcatcagctgccatgctgtcagagaaccacatgagacagctcagcattcaccgtgagctgaacttcattcaggcttcttcaagccagcttagccaggaggcgaatgtgagatgagtttctcatgtactgagagtttttgtgtgttaaaaattatagcatgatgcaaacaaaaaatgcattgacttattttcatgactggatgtcgttgtgctttgagggtaatgggcaggcattgctttctcttattgctgttggattaaaaggtgccggctacagtattgacttgataatctcaccaggtattcgtgcagagc

SEQ ID NO: 49998 - DNA, 604 bp, Homo sapiens
ccttatttgcattccacaccccttttcttagagtcagatttcctaattaattctcaacaaattgtactaaaattgaaatttctcactcaggaatatttaaatgcactcacgaccttttcaattttcacaatctaaaagaaattgatgtgctagacattttaaataagccaattaggctttaatgtcacgtatcactaatgcaattatatggaagatttgcttcattgtgcctaatgagaacaaacacctttacagtatcaacacagatatttaagaactaggctaacccaaatgtcttaggcagctacaaatttttttctcagaaaactacagtcacacgttgcttactgacaggaatatgttctgagaaatttgttaggcgattctgttgttgtgtaaacattctagtgtattcacgaacctaaactgtatagcctattgctccctaggctacaaacctgaggagcatgttattgaagtgaataacagtaggcaactgtaacacaatgggaagtgtttgttcatctaaacaaaaggcatggcaaaaatatggtataaaagataaaaaccgccaggcacagtggctcacacctgtaatcccagc

SEQ ID NO: 49999 - DNA, 347 bp, Homo sapiens
taataatctgttttctcttttgaaaatgtttcagtgtggataagttatcacaccacataatcaaaagcctaattgcagaggtgctgtgaaatggtcgatgtgccttattttctgctagagatgtcacagactagctttagttctagaaagtgaaacaggtaagtttgaggggctttgatcctcggaacctaagcatatgtcaagaagtcataaaggcaacctagaaaggctttgatgtcaatctgctatgtatgtttatagatgatctgtgttgcagtttgtttctgcagtttgttgcagtttgtagtctgtgtcacagctctgaatttattttcttctcagcactg

SEQ ID NO: 50000 - DNA, 581 bp, Homo sapiens
ctctacaaaaaatacaaaaattagccgggcatggtggcatgtgtctgtagtctcagctacttggaaggctgaggtgagaggatcgcttgtgcctgggaggcagaggttgcagtgagccgagatggcactactgtactccagctgggtgacagagtgagaccctgtctcaaaaaaaaaggtccattgactaaataagaagttagtcttaaaactagattatttagttaaaggagcaaatataatttggggaaggagaggaggagtaaaagcaaaagtatttaatctgtcttggaaaaaaaaaagaaaaaattacattggtcctttttgtatgtgtatttggaactaaagtcgtaatacttcattactggttctaaaataaaccaggtagccagcacagaattttggctgtgggatctttatgaaacagcaaaagtaaactagattattcaatgagtataggaaaatttagtaacgggctagttccgttaagatttgcacagttaagatagagttaatacaggtaggcacacagacttctaaaaggacatagctgttcctgtatacaccagtgagaagaaacc

SEQ ID NO: 50001 - DNA, 993 bp, Homo sapiens
  misc_feature (950)..(950): n is a, c, g, or t
  misc_feature (953)..(953): n is a, c, g, or t
tcctcttgacattagtattcagtagatcttgagtgggccattttaaaactgactttaaaagatgcaccccaggtaattttgatgcaggtcatcaacaaaccacaattggaataacattgccctacaggataaagtccaaagtttttggtatggcttaggattttgccgcttcctcctctctagcctcattttccatgagtctgtaccacccatcctatgcttcagaaatgctaagtcactttgagttctaacatgttgttctcacgtctttatacccttgtatatgttggttcctctgcctaaaacacccttctcctttctcttacatattcactcttcaggtctccactgaagcatcaccactttcctatcttctcaaactgagttaaactacgctcacttaacatacctcttttatagcacttaacagagtgtttcatcattgttggtttccttttctgttccctactagattatatgttccttgaggacagaggttgtcatgttcatctctgttcctccagtgtctggcatggtgaatgttccaatgaaatcaaagcttctcttgtgtctttggaacattgagcactctagacccatggaaatggctctgatagcactctgctgtcctgtatctgagcatgttcatgtggttttaagtttagagggctgacccaagatggtgcccagcctataagaaaatgtctgggggcacctcatttgatgtgtatggttagtggaaattaagctgtattggggaattggagaataaggttcatcaacatcagcatttagagaatggagagtggttttagagtgtgaattctttaagaaatgttgtaggacctaagttttttttggaaagtctctgagtaagtttcttaagttttttttttctttgagatggagttcactcgtcactcaggctggagagcagtgagccaagatantcngcccctgcactccagcctgggcgacagtgagactccatct

SEQ ID NO: 50002 - DNA, 364 bp, Homo sapiens
atctgcccgcctcggcctcccaaagtgctgggattataggcatgagccactgtgcctggtcttagtgaatcttttctggtagtttatgaattgatgtaataccagatggtctgttataaccaaagttgaaacacccgataaatgtcatgagagagatagctttattgtttagggagcatatggacatgaaactaactcctgtgtgttgttaaaaaagctttgctaccttttctaaacaaattttacagaaaaaaatcttacaggccaggtgtgattgttcgtgcctgtaatcctagcactttgggaggctgaggcaggcaagcccaggagtttgagaccaggagatagcaagacctgtctctac

SEQ ID NO: 50003 - DNA, 898 bp, Homo sapiens
tcatctgataaaggttttgtgctgcttcaactcatggaggaaactggaagggaaaggggcttgtgcagagagagaggggaccgaggaggctgacttgctttataacaacccactgtcatggtaactaatccagtcctgttagagtgagaactcactcccgtgagatggcattaatcaatttataagagatctggccccatgacccaaacaactcccattaggccccactttccaatactgtcatgctggcagttaaacttcaacatgaagactatactttcagagatcacttctgtagtttattattagaaagtttctctgaatgtgtagaacactggaaaaaatgatctaagactactgtgaatatgtctgtgcacacaaactagaaagtctagaggaaatggataaattcctagaaacacacaatcccacaaatttgaatcaggaagaaacagaaatcctgaatggaccaagtaataagtagtgagattgaatcagtaataaaaaatctcccaatgacaacaacaacaacaacgaatgcccaggaccagatggattcacagctgaattttaccagacatggaaagaagaactgatgccaattctactgaaactattctaaaagatggagaaagagggaatcctccctaattctttctatgaacccggtatcaccctaataccaaagccaggaaaagacacaacaaacaaggaaaactgcagaccaatattcctaatgaacataggtgcaaaaatcctcaacaaaattctagcaaaccagattcagcagtatatcaacaagataattcagcatcaagtgggtttcataccaggaatgcaaggatgatttgacatatgcaaatcaacaaatgtgattcaccacataaatataattaaa

SEQ ID NO: 50004 - DNA, 463 bp, Homo sapiens
caatgggctgcaaattgctctccaccccttctgattcctgagctgggtgtggcagcagattgttttttctcataaagaaataaaataaaataatgcattacctcttttagttatggacttctgccagaaattcagtgcacccaaccctcgcagttatgttacatttactcacttgatttagactcgaaggaaatgtttcctccttaagcaggtagcaggctgcgtgtggatttcttaatgaaacagttgttgtcatctttatgttttaaaaggaagccccaggtctctaaggaaattttcacatcagcaaaccaacttataagaatgttcattcatgtttgccaaccattgtgggaaaggagatgggatgacactcccagaccaccttccatctgcctaggtttgaataataggtgactatatttggaaaattacatgtatgtagtaaaaaacaaaaaaaata

SEQ ID NO: 50005 - DNA, 434 bp, Homo sapiens
taacctacacacatcctccattaaaaaccatctctagattacttataagagcgaatacaatgcctacacatcgcttcattatgattcaacatagtacttggcttgctgcaaattcaagttttgctttttggaactttgtagaatttttttcttaatatttttgaaattatgcagaaaacagaggtttcttctccacaacacccttctggtttccggtgagcctaactgtggctgaagatataaatgttcacactgcaagcaaactctgagcaccatccaccatcccaaagagctctccacatcgcctctcctcaaaaccaagcagctgccaggtccctgtgtggagatcctaggagaggagcttggagcctctgtatagctcaacctgaaaactaaaatgcgggattaaaactacaaactgacttgattctttt

SEQ ID NO: 50006 - DNA, 321 bp, Homo sapiens
ggggagaggtggggtggcctctttttcttcttttttaatgtataaagaaaaaagggcaaatagaacaaaaggaggaaagaaattagcaaaggagcattattgaaaatgatcaatcaaaagttacagacacgctataaagtctgagtattttaagataaagcaaaaaataaattaacatgattaacttctttgaacatcttgcctttagcctacacccttaaaattttaagatatcccataaaaagaaaccagttagaaacaacattttaaaggtagaagtagagcaattatgattaataatgaaaaatgcatatgcctatc

SEQ ID NO: 50007 - DNA, 374 bp, Homo sapiens
gttaaattcaccaggaagataaaagaattctaaatttgcatgtacctagtaatattgtcttaaaatacataaagcaaaaatcaacaactctataagactaaatagctaaacgaaaaatagtgggaaattttaacatacttttcaacagaaactgataaaatagttagacaaataattagtaaggatatagaagatttgaacaacttaatctatggacatatatggtcacagtgacatgatgaagctggcttgtatcctctcatgagaaacaatttttaaaatttcaagacttttgtgaaccagctgatatcgcgctagtagcttgacattgaccactatgggaatatttatataatagtatgataggcaaatgc

SEQ ID NO: 50008 - DNA, 1116 bp, Homo sapiens
aaggtacattagaattcagtgttttgaaataagatctatcttatttaataatttattcttagagtaaaagattttgtttgaactcattcttcttcactgactgtgacccctctagtcactgggaccacaagattttttgttttcaacagatgtcttttgttttaaaataataggcatggcaatataaatacataatgaaaaaagttttttaacagcattttttaaaataattgaaaccataatttaatgatttatatcagttacattcattatatagatttcttagttctggttagataattttaagtgaattcagttacagttccatgaatgtggataggaatttcctcatctacctaaatagaaggatgagggagttttagaaagctatatttttacttttgatggatatatacaaaagaatgggatcctcatgtgtttggtttttctaatccatgcgtcttgaacactttttccttctgcttgttcttagtgggcttggtcatgagagcacagttgtttttaagagtaataagacaaaaaataaaggaacaagactaacacaggattatacttttccctagcagagaataacactgagctaaacagattattagtactgaattgtccatttcacagctgggaaatcccagcaaatgaagcgtttaatgagaaatagaaacataatgcactttatttatatcaccagttccttagttcttaaacaaaaattaaaaagagggctgcatcttatgtggaattgagggctagtggcaaatagttttctcttaaatgttgttaatataaaccctgattaacgttttccatgtcataacccatgtgtccaaaatatattctaggccgggcgtggtggctcacgcctgtaatcccagcattttgggaggctgaggcaggtagatcacttgaggccaggagttcgagaccagcctgggcaacatggcaaaacccggtttctactaaaaatacaaaagttagccgggtgtggtggcacgtgcctgtagtcccagctgagggaggaggatctcttgagctcaggaagtagaggctgcagtaagccaagatcctgccactgtactccagccagggtgagaccct

SEQ ID NO: 50009 - DNA, 363 bp, Homo sapiens
aattgagggttgaagacttggtagggactagtgcagcatgggatagtggtattcactgcagagaagtgtctgccagcaggaggctggcaagacactgtcaaatttcatgagggagcaccaatgctgttaggagttgggtcctttgctgataggacctgcagggcatctaccttcatgtctacaaaaaagttactagtgaccaggcacaaggggacagtaaccttaccagcctcattgctaagaagtggttagcacatgtcttccccccgctcttcctggcctcttccaccaccagtcaagctggtgcaggagttggcagggacagcacatcttggaggcactatggaggttcaggggagcttt

SEQ ID NO: 50010 - DNA, 3757 bp, Homo sapiens
  misc_feature (830)..(830): n is a, c, g, or t
  misc_feature (3746)..(3746): n is a, c, g, or t
agattagtagatttctgcatacttccagcttctttcccccaggagatgcagccttttcatccaataatttttaaagtcttttccaagggcatttaatttccctgacttaaaaagagagtcagatggttacaatgacctttctgttatgacagaaatagtgaaagggacagtagtaaaagcacaagctatattattttcctcttctgaactctcaacgctttctctttcctgtgtcacttatcacttttgccttgtattctaagaattgctatacttctctccctgttagcttacagagttcttaagagcagaactgtcttgctcattttgtttcttcttctaactctatctcagggccttgtagacaggaggtacctggttgtagcctttttaaaggtcgtgtcatgagaggactctctcacattgggacatgttgtctctggttttagaaattaggagaaaagaaagtatcaaacaactgacctctaagttttacctggtctgttggcttcataattttaaccatatacccaaagcgttctcttatatccttcacttacgggtgatatttcttttgcatagtgggccacattgaaaagtgagagatctataaaggctgagtcctgtaggttggcagcttagctgtccagtatttaggaaatgagactgcaggattcacggacatccttgttatcttccataaggaaattatgaagggagaaattgccagaaggtcccagaagaatttttttcattcagtgtgggagatctttggtctatttgtttttctatttagaagtttaaactgtttatggacagtacttattaancccgttgaagatacgaaacttgatggaattatactgaaaagttaaaacatgttttctgcccttaaaaaatggacttttgatagagattaaactgctggaatttacatatctacaaagaatattctaaatacataatatatttatatatatggtacctgagaggaggaagaaatggattcatttggatgggatctggggttcatagcaggccagtttgggaaaagtatttttggaagaagttactcttgaggtaagagttcagaggaatattgtatggagagtggctgctgaaggaaaagacacagctagatctttcactgagttacacaatctaaggggctttcctgaagtgtgatggtttgagggaatcctttaaaagctctttggcttttgttaatcttatgcttgaagcctgagcaattctgatgctatggattgctctcttagaatcttttactccagagaaccccttctaatttgatatgggtaaagctaacaatgaagataaattttgagatgggataatactgcttggtttaaagaaggaatagttgatggcaactgcattctgttttctgcagcccccagcagctaggggaagagcatagcgaaattgctgagtttagtgagtacataggaaatgcaagtcttaagcagagtatccccccctaaatttggggtaacctctcatactgagatataaagaagaatcaatataaaatggataagattagctatctactgagtaatctatccaacagtttataaatacattgctcatgaaactagattacaaatctcaagggcctgggccagtagctcaatgaaggaaattatagcctctgaaatattttgtccagattagagccacggaattttgaagtgactttatcagtctaaggctatatcaagccactctcttttacttatgtggaaattggggtccataaggataaaataactctacatagacaaacaattgtggaatttggcaccagagcccaggactctgaccttccggtccagtattcttccatcatgtcagattgccttgccacgtgttacacctgttggaagttttctgggcagtaggcaagattgagaccaatttgtgagcagtatagagacctaacttaaaatataggaaaatggttcaaagctagagcgtctgccccaagtactgcctcttttcttattccacattcctttcttgccacttttagtcttgtacacctctagactcttacaagcaattaaagaaaaacttttatgtaattaattaatgatgtgtgaggaaatgtactaacagaggaacagagttgtatagaatccaaaaaaagaaaaaccaaggagtaactatttattaatttatctagcacaatgccaaaacagtgatacagtagaacaagatgaatatctagcttgcacaatgtatgtaaactaccccctgaagctatttgccgatttttgcccttttcctgtgtttaacaagtagcactctcaatatttattcagcttcccaggaaaaagcagccgaagatattttggtaactggactagacttcaccttgtaaactaataaattggcattttaatttcgaaattagtctcttataatttttagttaacatcagccagtcttctaaactctgaacatccctaaatgaactaataaaaactgagttagagactctggacctttggtgacccccgcaatgtatagagtccccaggaggtgctacctgaacagccatgcagggtctttcaattcatgtatctatttccctcccccaacatgtcttatcaaaaacactgaatgctgggggctcctctaacaccatcttagaatgtcaagctgcagtttgtttgttttttttctttttgagacagagtctcgctctgttgcccaagctggagtgcagtggtgtgatcattgcttactgcagacttgatgttccaggctcaagtgatcctcccacctcagcctcccgagtagctgggacaataggcatgtaccaccatgcctagctgatgtttttgttatttttagtagatcctgggtctcactgtttttcccaggctggtcttgaactcctggcctcaagcgatcctcctgcctcagcctcccaaaatgctgggattacacacctgaggcactgcaaccagcctcacactggatttaaaagcacatcacagactattatttggagagtgcttatttgatgctgtgtcttttgttcagtaccgtaagtggactcaaccatacaacccatttcatccaacctaacatgtacagaaaaatcttcccttcaattctggggctttgcacagctggagaagcctttggacagtaaatgggagatgtggaagttctagcttggaaaggatctctccaagcgctcgtaactcataactttcttttctttaacttatcagccagagaaggagggaaatattgatgccctattaccgctctgttttcttacagccgtttttggaaattttgtgtcagaggacttcccagagttttgttcctctgatcttgagagccctaatacctctgggtctgaggactggttctagctgtacttaccttgtcagaaccacctgggaggaccagcagtattacagcccctctctcctgaaactgcttctgaggtctcaaagcctgaatcaaatgaccattgtactagccttgtattggggctcagaatgtcagttttcagcttgtcctcatatataaatataggtctctctagatataaaaagtgagaaagtctgtaagttgcattttttttctataccccctttcataggacacgctaatgagatgcatatcattaaaagcctgatgttttgtgggacggagccttttaaactggatgtgcctggcttagttatggcaaatatttaccnaaaaaaaaaaa

SEQ ID NO: 50011 - DNA, 295 bp, Homo sapiens
caaaacaaaacaaaaacaaacaaaaaaccaaataatatattctactttaaagagcattttactttctttcgatataggagaatatcgataattatgtattatatacagctggaaattaaaagatcaggaacaaatctaatatttgacatcattggacttatttgtgtattttgaattaaggtcatttgtggtcaaaattagttaaaaggattgtttatttagtcatgttcatgtcatagatttctacaaagagattatatagtattttatagcttgaaatgtttctcaaatatat

SEQ ID NO: 50012 - DNA, 885 bp, Homo sapiens
ttaaataacccacttttttggtgatgcaagaacaacaggcatcttttaaggacatggcagtcctgcattttaaccactgccctcactccatttcctaagcttcactacaagaacatctgccctataatctctaattcacaaaaatctttctctatttgtttttttgactcaaccaggagcttgaagctaagatgatgctcctcttagcactgtttagacttatttaccaattcagctttaaatcttatattgcctgaatgatgaaagtataggagagaaaagagaaggaagccatttctgcctgttctgggacttagaaattcttagataaaaggggctgaataactacaaggaactgagtccctggaaagaatgctgatatagaatctcacaattcaagctaatctggactttatggggcagggaggaaggtaatccattccaaataccaaatttatacctgaagtatgatgcaaggactggaaggaaagatcagaaaaaaaggtgtatggtgtgttaaccaggattgtctcaggttgcctgtattttctcatagtcatacacagcatgtagagcttttataataacaaacaaaactttagaaggataaaaggggatgaggagtgaagaaaattgggctcaagggtctgaaatccctaaattctgtaggctaaactagaacccattctttgtgcagcctgctctgttacagatatccagggtccccatttctggatttgttgataaaataacctttctgttgccaagaggaaacttgactgaatattcctgagaaaagttcctcattaatgtgactacaaattacaacgtttccacaacctgatggcctttggcaagattgtgaaactacacccctaggcaggg

SEQ ID NO: 50013 - DNA, 722 bp, Homo sapiens
tggatccagtgtatgctgcttgggtgatgggtgcgccaaaatctcagaaaccaccactaaagaacttattcatgtaaccaaggaccacctgttaccccaaaagctattgaaattttttaaaaaagaaaattggaatagtatactttcatttcctctctcccagccagatacttctgggatttgtaggattatagttttctttacatttaggaaagttttgggccattctttttttatttttctgtctctctttttccctctttggggacttattcctccttgaagttttctcataggttcactgatgtctcaaatttatgaatcttctctttgggtgatgtctaatctgtgttcacttcccatccattttagctttcattcctgacattgtaatttgaatctctacaagtgtagtttgctttaaagaaaaatcttccggccgggcgcggtggctcaagcctgtaatcccagcactttgggaggccgaggtgggcggatcacgaggtcaggagatcgagaccatcctggctaacacggtgaaacaccatctctactaaaaatacaaaaaaaaattagccgggcgcggtggcaggcgcctgtagtcccagctattcgggagcctgaggcaggagaatggcgtgaacccgggaggcggagcttgcagtgagccgagatcaagccactgcactccagcctgggcgacacagcgagactccgtctca

SEQ ID NO: 50014 - DNA, 1295 bp, Homo sapiens
ctcagcctagagcggctgctgttcagctttggcccctgaagggagaacacatctgaggatgaagaatggttgaggcatttgttcctctggttttctctctgctccagtgcagtaggttggccttgcccttcttctgaagcccccgtttccatcgggtggctggtttcatgcagctgtggctcctcacagattccctctctcagttgccataactgctaccctccttgctcctacaggcactggggcagaagtggttcctccattattagcagcccagggttctttcaacctgcctacatctggaaaatacctccttatcaaactcttcatcaccagtgtcagttcatggtcagtttctttcctgagccctgacccacacccagggaaaggccaaccttccgtggccaagatgaagcctcttccactgtcagctgggcacttctaggggctgtgagcgctgaagaatggagagattcaggccatgtgtgtggctctacctcctgagaaacaggcgttatcaggcctgggctttgctcacagcacctgccggctcctgggaagaagccacatctgcctcgaactgccctgactgcctttgttacgatacctacccgtggcttgcttgtgccaactctgaaaacacagggctgcctgagggagctctcgtgttagcaagcagcagctcgtgggtaaggaaagccccttcatttattaacattaaagtgattgcaaactcgtaggtgagatacttatgcattgggctctgtctggataattcacctgtattaactcagccgatcctcttaactccataaggaaggaatccttattgtccccatcttaaagacctccgaaacgaaaccagagatactgaatgatttgcctgggatgactccgctaccacttggcacagccacggtgcaaacccagttgggctggcactgaacacccagactgtagatccctcctgcctgactcaagagcctctgtctatatggaagcaatcaacttaaggtgctggcagctgataaagacttgatctctaacttctctcagatatctacatctaacttagtttgggacaagggatagcttgctggggtcagcaaactatggcttgtgggccaaattgggtctattgcctgatttttacaaataatttattgaagtgaaattcatataacattaaccatcctaaagccagcaattcagtggcacttagtacattcccagtgtacccctctatctagttccaggcacttccaacactccaaataaaactctcttatggactc

SEQ ID NO: 50015 - DNA, 1302 bp, Homo sapiens
ctcagcctagagcggctgctgttcagctttggcccctgaagggagaacacatctgaggatgaagaatggttgaggcatttgttcctctggttttctctctgctccagtgcagtaggttggccttgcccttcttctgaagcccccgtttccatcgggtggctggtttcatgcagctgtggctcctcacagattccctctctcagttgccataactgctaccctccttgctcctacaggcactggggcagaagtggttcctccattattagcagcccagggttctttcaacctgcctacatctggaaaatacctccttatcaaactcttcatcaccagtgtcagttcatggtcagtttctttcctgagccctgacccacacccagggaaaggccaaccttccgtggccaagatgaagcctcttccactgtcagctgggcacttctaggggctgtgagcgctgaagaatggagagattcaggccatgtgtgtggctctacctcctgagaaacaggcgttatcaggcctgggctttgctcacagcacctgccggctcctgggaagaagccacatctgcctcgaactgccctgactgcctttgttacgatacctacccgtggcttgcttgtgccaactctgaaaacacagggctgcctgagggagctctcgtgttagcaagcagcagctcgtgggtaaggaaagccccttcatttattaacattaaagtgattgcaaactcgtaggtgagatacttatgcattgggctctgtctggataattcacctgtattaactcagccgatcctcttaactccataaggaaggaatccttattgtccccatcttaaagacctccgaaacgaaaccagagatactgaatgatttgcctgggatgactccgctaccacttggcacagccacggtgcaaacccagttgggctggcactgaacacccagactgtagatccctcctgcctgactcaagagcctctgtctatatggaagcaatcaacttaaggtgctggcagctgataaagacttgatctctaacttctctcagatatctacatctaacttagtttgggacaagggatagcttgctggggtcagcaaactatggcttgtgggcctcctcggcctcatcgtccttctttctccttttccttctttctctctccctctcatgccaccatgtaagatgtgacttgcttccccttcgccttccgccatgattgtaaggttcctgaggcctcagcagtcaggcagacctgtgagacaattacacctcttttctgtattcattaaa

SEQ ID NO: 50016 - DNA, 815 bp, Homo sapiens
ataatgctgcaatgagcatggaagtacagatacctttaggagttgatgtatttcctttgggtatatacccataaaagagattgctgggtatatttttaagttgattggcatttaataagataataaatagcatgctgctgctttgaatcttccatatttgtctgtagagcccctgttttctaatgcagtttatgtaaagtttttctactttttcttgggcagtatctattttaattacttttaaatgacttggatgtattaatgttttctcttttaacaaaaatcacaattataccccaaattatttttgcataaaaagtatatgcttttaaaaataaatgatatgacaaaaatatcagctataaaactatcaccatgagaatactgcctgtcctagtcccttaaggatatttattagggaggaaaaaaataacagaggtcgtttgcttttcagtgaccaggttcttcatacacatggatgtctcacagatcagctaaggcctgtgtttgaacaccttggtcacccctgcaaggagccatgctccagcatttgccatccacagaacggtgctaatagagtctatttctggagaatggaggagagattaacttcttgttcatgataaatcaagggtatctgatttgcctgttacatgcccagttttctttggaagcaagccctagaagctatttttctgatctaatcctaattctcacattagtgcttatgaaagaggaaaacaacatttactcacgataaagactgagttctagccattataaatcttatcaattgccttgtgaaggttaggggg

SEQ ID NO: 50017 - DNA, 6838 bp, Homo sapiens
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacgcgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaaaaaaaaaa

SEQ ID NO: 50018 - DNA, 6784 bp, Homo sapiens
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattatacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacgcgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaaaaaaaaaa

SEQ ID NO: 50019 - DNA, 6787 bp, Homo sapiens
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacgcgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaaaaaaaaaa

SEQ ID NO: 50020 - DNA, 2390 bp, Homo sapiens
ttgtaacttaaattataccactgactttcctggtctcccaggaaatatgcagacagtatatcattggacttcttggcctccagatctgtaagaaataaattccttttctttataaattagccattttcagaatacttgaaactggctaatttataaagaaaaggaatttatttcttacagatctggaggcagagaagtccaaggtcatggggtggaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaaaaaaaaaa

SEQ ID NO: 50021 - DNA, 916 bp, Homo sapiens
ctccctgacgcttacgagcgcctcatcctggacgtcttctgcgggagccagattcacttcgtgcgcagcgacgagctccgtgaggcctggcgtattttcacccccccttgtccagtctgaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaaaaaaaaaa

SEQ ID NO: 50022 - DNA, 793 bp, Homo sapiens
accaggaaacagctataccgggcaaagttatatgcggacaagacgcatattaacgaggagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaaaaaaaaaa

SEQ ID NO: 50023 - DNA, 1055 bp, Homo sapiens
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatggtgaggatattttttatcagagggttgtacagataattataatccttaaaattttaaattatagatttcagattataatttaagatttaaattaagatttaagaattaaaaaccttgtgccaggcgcagtggctcacccctataatcccagcactttgagagaccgaggcgggcggatcacgaggtcaggagattgagaccagcctgaccaacatggagaaaccccgtctatactaaaaatacaaaattagccgggcgtggtggcacatgcctataatcccagctactagggaggctgaggcaggagaatcgcttgaacctgggaggcggaggttgtggtgagccaagattgcgccattacactccatcctgggcaacaagagtgaaactccgtctca

SEQ ID NO: 50024 - DNA, 168 bp, Homo sapiens
tcctatgatcatgcacacaagcaggtgagttgtagttacttgctaacagaagaaggtacctatctattgttacaacaattggattttatgagtataccccccaaaacttggtgtctatgatttcttgtgtctgccaatctttatctgcagtcatccaacacactttgt

SEQ ID NO: 50025 - DNA, 4932 bp, Homo sapiens
  misc_feature (4926)..(4926): n is a, c, g, or t
agagcgtcgtcctgagaggagtgaaggcggcaaaatggcggaccgcttctcccgcttcaacgaagaccgagactttcagggtaatcactttgatcagtatgaggaaggacacttggaaattgaacaagcgtcacttgacaagcctatagaatcggataatattggacaccgcttactccagaaacatgggtggaagctgggccagggattgggaaaatctcttcaggggagaacagatcccattccaatcgttgtcaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacgcgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctttgtcccagttttcttactccataagttgtgcataatggcgtganaagggt

SEQ ID NO: 50026 - DNA, 862 bp, Homo sapiens
tatactgcactaaattacattttggaaattttagctaatcttttcaaattaaaggcaccaacattaatgacagatcttctctaatatgaaaagcatcaaaacattccctttcaagcactttgaatggatgaaaattgccatataattttcccacctacctaaccattccatgtaagttaactgagcagtctaacaatgttgtacagaaggttgacagactatgtgcaccaagaatatttaagttgtgcagttagcaagaactagccatttcaaatatactcaaatgttttgtaaataaaaattttgactcctataattttgttcaaactgatgtcttttaaaataattagattttatttgaattttaaaagtaatctgttgtaaattagatgttactttgttgactctgtgattcaatgtacactcagccatattcctgtggggaaatatcaatcttactgactttcatggcatgagccagagattcatagtttcctttaggactataagtatgaagacaaaacacaccaaaataaaatgctagtgaagaaattagaaacctattgtataaaatgtatttttaaaatcttaagatatatgtgatttacactgcctgttaatctagtctctttgtgattaaaaaaaaacataatatttgttaagactcagacaccaaatatttgtgatgtttgtatagcaccatcgttatatgtgatttcaaagggtaagcatctctgtcgtaatcatgtaagcccacagaagaataaattcctgaggttatgtacaaccaactctcagaattcagacttcctgcagctgccatatcaccaataaatgagaattgtgaaaaacaatttttaaa

SEQ ID NO: 50027 - DNA, 5465 bp, Homo sapiens
gtggggggtggtggtgaagccactaggctttttctcattgcaggctacaactgtagaaatgacatttacaaccaaagtgctgtctgcacccacattaagccctctggacaatggccaagaaccccccactcatgggccagagcctacaccgagcagagaccaggcagcaggtaaggaatggaacagcaaacctcccaaggtaccaggaaaggggactccatgggccaacaaggtctgaagatgactgaggccaaggtcaactgccttggtattgagtgggtggggtctggcttaaacgaagttccctcctcattgtactttcttctctctcccctagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccactacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgttcggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagccctcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatacaga

SEQ ID NO: 50028 - DNA, 282 bp, Homo sapiens
acttagctcctttcaattcaggtgagtagggaggctgggaggagctggacttcagagaacatccccctctaatgacatgcccttccttttccttcctgattcttcccatgcccaatctcctgtggccttcctttgcgtcaggctcttgggggaaagaagggagggaaggggcatggaaatccggtgctgggaacgggtgtgtgtggctggaggtggcctatggcaggaagaatgatgggacaggagatggctaatccttcatccttcctttcacctttctag

SEQ ID NO: 50029 - DNA, 5869 bp, Homo sapiens
gtggggggtggtggtgaagccactaggctttttctcattgcaggctacaactgtagaaatgacatttacaaccaaagtgctgtctgcacccacattaagccctctggacaatggccaagaaccccccactcatgggccagagcctacaccgagcagagaccaggcagcaggtaaggaatggaacagcaaacctcccaaggtaccaggaaaggggactccatgggccaacaaggtctgaagatgactgaggccaaggtcaactgccttggtattgagtgggtggggtctggcttaaacgaagttccctcctcattgtactttcttctctctcccctagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccagctgtctttggcccccagctacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgttcggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagcccttgcccatcttcacagacacatacacccatcttggcaccctgattattcatacatgtctgcctaccacacacaaaatatatccttggttctatcttccttttcctcactgaattcccagctccccatccccataaatgcatacacatacatgcacacacacacgttatcccatgatgttccactgagaaaacaccaaaaaattttgaaaaagaagataaaaagaagaaacgaaaaagaaagcccaaggcaaagaagggggaaggaaaacaaacttcgccactctctcttctccttcctaaccctttgtctagagcaccacaccgctcacaaactctttccaaatgctcagttggctcccaaagttggagcctggcatgggcagggagcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatacaga

SEQ ID NO: 50030 - DNA, 5851 bp, Homo sapiens
gtggggggtggtggtgaagccactaggctttttctcattgcaggctacaactgtagaaatgacatttacaaccaaagtgctgtctgcacccacattaagccctctggacaatggccaagaaccccccactcatgggccagagcctacaccgagcagagaccaggcagcaggtaaggaatggaacagcaaacctcccaaggtaccaggaaaggggactccatgggccaacaaggtctgaagatgactgaggccaaggtcaactgccttggtattgagtgggtggggtctggcttaaacgaagttccctcctcattgtactttcttctctctcccctagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccactacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgttcggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagcccttgcccatcttcacagacacatacacccatcttggcaccctgattattcatacatgtctgcctaccacacacaaaatatatccttggttctatcttccttttcctcactgaattcccagctccccatccccataaatgcatacacatacatgcacacacacacgttatcccatgatgttccactgagaaaacaccaaaaaattttgaaaaagaagataaaaagaagaaacgaaaaagaaagcccaaggcaaagaagggggaaggaaaacaaacttcgccactctctcttctccttcctaaccctttgtctagagcaccacaccgctcacaaactctttccaaatgctcagttggctcccaaagttggagcctggcatgggcagggagcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatacaga

SEQ ID NO: 50031 - DNA, 5792 bp, Homo sapiens
gtggggggtggtggtgaagccactaggctttttctcattgcaggctacaactgtagaaatgacatttacaaccaaagtgctgtctgcacccacattaagccctctggacaatggccaagaaccccccactcatgggccagagcctacaccgagcagagaccaggcagcaggtaaggaatggaacagcaaacctcccaaggtaccaggaaaggggactccatgggccaacaaggtctgaagatgactgaggccaaggtcaactgccttggtattgagtgggtggggtctggcttaaacgaagttccctcctcattgtactttcttctctctcccctagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccactacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgttcggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagcccttgcccatcttcacagacacatacacccatcttggcaccctgattattcatacatgtctgcctaccacacacaaaatatatccttggttctatcttccttttcctcactgaattcccagctccccatccccataaatgcatacacatacatgcacacacacacgttatcccatgatgttccactgagaaaacaccaaaaaattttgaaaaagaagataaaaagaagaaacgaaaaagaaagcccaaggcaaagaagggggaaggaaaacaaacttcgccactctctcttctccttcctaaccctttgtctagagcaccacaccgctcacaaactctttccaaatgctcagttggctcccaaagttggagcctggcatgggcagggagtcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatacaga

SEQ ID NO: 50032 - DNA, 603 bp, Homo sapiens
tcttgctctgtcattcaggctggagtgcagcagagcaatcatggctcactgtaacctcaaactcctgagctcaagcgatcctcccgcctcagctttccaaattgttggggctacagtcacatgtcaccacacccagctaaatgtaaaatatttagtctttttctattaggtataaaatacatatttaaaacattttaatcagctttcttcttgaaatctggcacaagtttctagattaaaacattaatatgatttcacaatgataaagtaaaaatgaaagcccattttcaagctcatttaaccactgcctcatcagcagatggtactatgggttatttgttaataaattctgcctgttctttcggatgaggggctttgagaggagtcagcttttacccccttatcagttaacaccggggaacctcatggtaaagccagagagacctattcaggtcagctctgcctcgtgttgccacaaacagcaaccttggaaacctcactatgctcaagtgactcatctacaaaataaaacgacctacccatcccacagcgttattatgagtatttaagaaaataatgtctctaaagcacccagcatacgga

SEQ ID NO: 50033 - DNA, 681 bp, Homo sapiens
tccaccccacagagaatgtctaatgagagcttttcccatgcctggggcagatggctctccacttgcaactcccagtgctgatactgtcattcagttgttcagccaccctagagacaggccaattgtcctgaagtggcttcctcgtacatggcataagctccctgaaggcaggacttgtctctcttgtccattgataggtcccctagcaaagtgcctggcatacaataggtgctcaatagctatttattggatggagggatggatggatggacatacagatagggaagaccctctttaccttgagaatcccaggggtattattatttatgattattttattatgcccatttcttttatcaaaatatgttagaagagctgaaagaggcaatcgccttgtctatctcattaacccaaagccctttggggtgctctgtttgcatcagccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaaggtttgtaggccaatggcaacaatgtcaaacgtgaggcttggggctcttgg

SEQ ID NO: 50034 - DNA, 3843 bp, Homo sapiens
  misc_feature (1)..(1): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccatctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50035 - DNA, 3788 bp, Homo sapiens
  misc_feature (1)..(1): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactttttggcaaaaccccttttcccttataggggaattttaata

SEQ ID NO: 50036 - DNA, 3426 bp, Homo sapiens
  misc_feature (1)..(1): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctgtgtcttaacgggatcgtctagatcacctcagcaa

SEQ ID NO: 50037 - DNA, 4177 bp, Homo sapiens
ctctatttatccatctgaccgctggctgcggtcagccctagggatcactaacccatcccaataggccccaggaaagagaaaaccacattcccgctcactgtattagagatggggttcccagcaggaaacagagcgaaccctgggaggccaattgaagagattttatgaagggactgcttcagagagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50038 - DNA, 4027 bp, Homo sapiens
ataggctagtatgagctgggtttaatcggcagaggtatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50039 - DNA, 1263 bp, Homo sapiens
gcgcttggtcatctagaggatccctaaagacgctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50040 - DNA, 334 bp, Homo sapiens
tggaccctgatgcggctaggcatagcattgggtaagggggcgtgtgtcgatgagaatgataaggacaatccggcctggatgttcctatgcctgctggtctgaggccaggactcagagaggggaactggcttctcctagcacttacagggaaagtgacagaggcaagaccagaagcccaagctcttgcacttggcagcctggcatcttgacctgcctggactcccccacctagcatggtcctgggcatccagagctacttgtcctctgtccggccttgaaggcttattctctgcaccacagctctcaccagtcctatgtggtaagatctgacagt

SEQ ID NO: 50041 - DNA, 381 bp, Homo sapiens
aggcacacagccagggttgtgggtgtggccatgaggctgctgagatgaaatggggagcagctgaagacagacaccaggcccagccgctgtcttgatgacctcagaaatatcacttgtcgaggccatgggcccctcatctataaaatgggtgtcatcctggtactaccttgcatagttgctgtgcagatcatgtgccacacacatgcttggcccagagcaggcactcaccatcctttttccttacgcagcctctggattatgaatacatccagcaatacagcttcatcgtcgaggccacagaccccaccatcgacctccgatacatgagccctcccgcgggaaacagagcccaggtcattatcaacatcacagatgtggacg

SEQ ID NO: 50042 - DNA, 4548 bp, Homo sapiens
  misc_feature (1)..(1): n is a, c, g, or t
  misc_feature (4096)..(4096): n is a, c, g, or t
  misc_feature (4099)..(4099): n is a, c, g, or t
  misc_feature (4117)..(4117): n is a, c, g, or t
  misc_feature (4124)..(4124): n is a, c, g, or t
  misc_feature (4126)..(4126): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacaaaanaanaaaacaacaaaaaacaanaaaaaananaaaaaaagaaaaaaaaaaagacaaacaaaagaaaaaaaaagaaaacaagaaaaaaaacaaaaaaaaacaacaaaaacagggcgagagaacaacaggagagcaacggaagggggagcgagaacagaagagcaacgacgagaggaggaggaagagcaagaaacacaagggggaggagagaaggaaagagggggacgaaacagaggggtacacaaggagagagcatgagtaggaacaaaaagaaggagagaggtggggtgaatggtagttaaaaaatagagaaggagagagcaggtggtgggggaacgaaagaatggggagagatgtagtgagaagataaaacgggaggaggggagagagaaaggggggcttcaggtgtggtgtatagagggagggagtagtataggggtggagtgagcgaagaa

SEQ ID NO: 50043 - DNA, 4092 bp, Homo sapiens
  misc_feature (1)..(1): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50044 - DNA, 3824 bp, Homo sapiens
  misc_feature (1)..(1): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccacttcgtgggcagcgctgcccacgaagtggaataagccttcgaaaagaaattgtccttgaagcttgtatctgatatcagc

SEQ ID NO: 50045 - DNA, 4049 bp, Homo sapiens
gtgtctaagtactcctttcatcgtcactggccagaatctgaatgtgtctcctctttccatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50046 - DNA, 3634 bp, Homo sapiens
tccaccccacagagaatgtctaatgagagcttttcccatgcctggggcagatggctctccacttgcaactcccagtgctgatactgtcattcagttgttcagccaccctagagacaggccaattgtcctgaagtggcttcctcgtacatggcataagctccctgaaggcaggacttgtctctcttgtccattgataggtcccctagcaaagtgcctggcatacaataggtgctcaatagctatttattggatggagggatggatggatggacatacagatagggaagaccctctttaccttgagaatcccaggggtattattatttatgattattttattatgcccatttcttttatcaaaatatgttagaagagctgaaagaggcaatcgccttgtctatctcattaacccaaagccctttggggtgctctgtttgcatcagccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagtcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 50047 - DNA, 1124 bp, Homo sapiens
  misc_feature (1)..(1): n is a, c, g, or t
ngacggtcggctgacaggctccacagagctccactcacgctcaggccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagagtgagcccctcctctagggccctgggaaggggggctgggataccccagactcagtgacttggggctctgggaaaagagttacaaatcactttacctctccctctatcccagggtaggcctgatgcccaaaggagtcctttgggtgaagggaggggccctgcttccatcccaataccacattcccaaggccatcctgccgccccctgccacaatcccctcatag

SEQ ID NO: 50048 - DNA, 966 bp, Homo sapiens
gttgtcgatttcctttaaaaagttacctatttatgttcttactaagagtatatgaaattacctgttctcctaaactcttgttagctctggaaattataatttttaaagatcttcgcaaattttgtttttgctataagacaattatttcagttaaattttttcttgaaaattttagtttgccaggatgttttcaatcctgtctctgtctctgataagttttctatctttaacttcatgttacttgcaaatttgacaagaatttaaatgttgtaaaaaaaatagggtttagcctagaatcctgtagcaggccaacagaaatttcccatcaatccactagttagttctgcatccctaggtacaatcattcagcaagtccctaacccacttaattacctcagtctctaactgatattttcaaacctttcctaaagggtacaatgaaagacaatgtcaaatattttgttgaggtctggatttagtacctaccacatttctctggtgaaccaatctaataaccctatgaaagaataagtctttacctgtgtacaaccctttacagtttggacacatttttaaattcatttattttcatttggacaaatgaaaatatatgttgcacatactcagtccatccccctattttcagcctccctttcgaatgtagttggggcctccaaatcctaagcctttccagagttccgtagcatgaatctgtttcttggctttttcactgccaggttgggtttctggtctgctgagccagtgccacccaaccctgttcttcccttaagagttacatctcctatgagctaggcgcagtggcatatacctatagtccagctacttgggaggctaaggcaggaggatcacttgagcccaggagtctgaggctgcagtgcactgtgatcacacctgtgacgagccctgcactccagcctgggcagcatagcaagagctcatctcttt

SEQ ID NO: 50049 - DNA, 313 bp, Homo sapiens
gaaattctgggtctggcttccagggtctcagtgttccagcctccacactttaaagagagggctcagatgctctcattgtctggttctgtcttggtcctatttattgataataccctagctcactgaagccaagagttcagtttttggtttatttatttatttatttatttttgagacagagtttcgctcttgttgcccaggctggagtgcagtgatgcgatctcggctcaccgcaacctccatctcccaggttcaagtgattctcctgcctcagcctctcaagcagctgggattacaggtgcctgccacaatg

SEQ ID NO: 50050 - DNA, 199 bp, Homo sapiens
cacgctgctactgagatgttttgtgtatagtggcctcgctccgtgcatctaagttgttccttgatacacagaggaagcacgcagccctctcttccattttgcaagtatttggagcaatggagcaggagaaactgacttgccccaaatctctgatcattttctagacattgccctaccctggtgacttagggtcgtgact

SEQ ID NO: 50051 - DNA, 758 bp, Homo sapiens
tgtgaacagatgcagtggtggggatgcagcagaggaaggggtcaggagtgccccaggagggggcggtaccgaggcagggattcagctgggtctgagagggaggcaaggctgagggggatggccctttggagtgggcagggacatgaccacagaaagcctgggaagtggaaacagacaggagcctgctggagctcttggagctttgtgtggggcactgggggaaggaggcaggcactccaccctgacctgcccctacctcggatgagggtcttctctgcctgttggatgatgtgctgcccctgctcttggaggaagaggcctcccagccaccccctcctgccagtcgccctgacctgctgacccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccacagagagagcgtcgccccacagagagagcgtcaccccacagagagagcgtcacccccagagaga

SEQ ID NO: 50052 - DNA, 920 bp, Homo sapiens
tgtgaacagatgcagtggtggggatgcagcagaggaaggggtcaggagtgccccaggagggggcggtaccgaggcagggattcagctgggtctgagagggaggcaaggctgagggggatggccctttggagtgggcagggacatgaccacagaaagcctgggaagtggaaacagacaggagcctgctggagctcttggagctttgtgtggggcactgggggaaggaggcaggcactccaccctgacctgcccctacctcggatgagggtcttctctgcctgttggatgatgtgctgcccctgctcttggaggaagaggcctcccagccaccccctcctgccagtcgccctgacctgctgacccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccaccaaagaaaccccactgtctcccacagactccaggtctgtatctccaactgcctactcaatacaacacgtccacctgatgcaatgaacttaatgtgtctaaaccccaattccacatttccagtcctcctaccggctcctcccccagtcttctctactttactatatgacaactccatttttcccaatactggttttaaaaaccctggagtagtccttgactccagt

SEQ ID NO: 50053 - DNA, 657 bp, Homo sapiens
tcaccggtcgggcctgggaccagcctggcgccttcgtgtacactagcatgggaaccatcaacccagcaggccatggaccaacttcactatgtgacagaccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccaccaaagaaaccccactgtctcccacagactccaggtctgtatctccaactgcctactcaatacaacacgtccacctgatgcaatgaacttaatgtgtctaaaccccaattccacatttccagtcctcctaccggctcctcccccagtcttctctactttactatatgacaactccatttttcccaatactggttttaaaaaccctggagtagtccttgactccagt

SEQ ID NO: 50054 - DNA, 574 bp, Homo sapiens
gtagtcaacacttttgaaggctgaaaaaccagactgctggtcccgatgaaacccaggatccagagggagaactgctcctgtttgtctgccctttctcaactgattctttctgaataatccccacatgcacactgggagaatggggtggagccacgggaggtttgcaccttgtgcagaggggaggagcctgacctcttaagttcatgtgtgtggtggtctggtattcaatatgtgaggtgggagcctgttagcagaacctcttcttttttggctgagagctttcttttaataaattgctctctcctcaaattacaatgtgtctgtgtgcctaatctctcctggtcgtgtgacaggaacccaattttaactgaactaaggagcaaaaattctgcatcaattggaggaattactttctggatatcagtacctattattaattatatcaatcaagacatggcagtactatttgaaggaaacccagataaaccaatggagcagaatatcaaatccagaaaacagttctcaaaaacactgcctcctataccatgacagatgtgacatgcaggacagtaag

SEQ ID NO: 50055 - DNA, 352 bp, Homo sapiens
cagcgatcccatggcctttgcacgtgggggtctcggatcccccttcttgtttctcccagactccaggcctcctgtcctctcactgcatggtcgctaaaaagagatccactgggttactgaggccaacacccactcctgggctgcttagtgtcagctctctgtctggtctttggggtccctttgttatctggccctacgtggcctctttccttgccagctgaaatgtgcatctaaacagatgttcattctgtttattgagctggagggcctttagtttcccttgttgatcgtatggctgaaactcgaagtcgctacgctgttgtttttcctatgcaaaattaaaggtagaaaa

SEQ ID NO: 50056 - DNA, 456 bp, Homo sapiens
gtctcgtgaaggttttctcaggagacagaccttaaaacctgtctctgggcccacagtaaagaacttggggaaagagaatcatggttcagagtatacactgaggtgggagggaccccagaaaaggcttgtagttgaaatgtagacctagaaaagagaagttcgtagtatcaccaccccctgattctctaagatggattgggaagctgcggagtgtgaagctctgggactttagttttgtggcgatatgagcaactacccatattgaggcatttctcaaatgcacaaacattgtttcatgagtcattttagcccagataggtcatggtgtcagtggcaaatgctgcaggtggcagatgcctgttacatgaatcacagtggccagtgcagacgttgccagcatccgagatggctgcgaccctgagtagggccctgatgatggaccagatctttctgtgt

SEQ ID NO: 50057 - DNA, 659 bp, Homo sapiens
ggagtttccccatgttggccaggcaggtcttaaactcctgacctcaggtgagccaccgcacctggcctcatttttctctatgaagtaaaataagggtccagttgcattcttctgcatgcaaatatccagttttcccaacagcatttatttaagagatcgtcctttccccattgtgtgatgttggcacctttgtcaaagatcagttgaccatgagtttggatttgtttctgagctctgttcttccattgtgtgtgttttcatgccagtattataaccgtaataggtccgttgccccatgagcacagcatgtcaatacagcaggttgcagcaaagaaagacggtttactgtaaggctgcagaacaaggaggtaggatgaaaatgaaatccgtcctcccagggagtttggagctagggtttttaagggttttaaagtgtggaaatcactgcttaaagagtgcagtgtggagtcatgagacaggaagatgaagaaactattctcatgctgattctgttcctctgtggttgtcttcagactgcttggcatcagctatttcactggaatttgggacctgagaaacatcttgtgcaattcttaaaagcctcatgattctaacattagaaatcctatgtatgggaacagtggggactctgtctcaaa

SEQ ID NO: 50058 - DNA, 219 bp, Homo sapiens
ttttttaagtagagacgaggcttcacggaagcaacagcataattttagtttaaatataattttttccttattgacagtcattcgacatggacttcaatgcacatggagaaactgtagatgcaaggaaatgcttgtttgtgcttgacactgtactgaattctgagtgcaaagcacattagaaatattagaaataaaggcagcatgtagattcaaaggccc

SEQ ID NO: 50059 - DNA, 307 bp, Homo sapiens
taaaggaggacaggattctaagtgctgccaggtcctcctgattcttttgtttacagggaagtgacctgatttacctttttaaaagctcactctgtgtagagaacagattttaggggtcaagggcagacccagaggagagacagcgctgacttgaccccacatgctagcagcagaggtgcagagctggagagaggtcaggacccatcttggtggagtgtggggacagtgtggggagcgggagacaacgccatacgcacacccctccctttgcaggcctcctggtcccaggcacactcaccacccctgg

SEQ ID NO: 50060 - DNA, 307 bp, Homo sapiens
caagtgcaatggaccaaatgtttgtgatctcacaaaattcatatattgaaatcctcatccacaatatgatgatattaggaggtggggctttgggaggtgattaaatcaggagggtagagctttcatgaatgggttagtgctcttataagagatcccagagatgtctctaggtctctcttcaccatgtgaggacatgacaagaagatgagaagatggccatctgcaagccaggaagtgggtgttcacccacagagagagatgccttgatcttggacttcccagcttccagaactatgagaaataaatg

SEQ ID NO: 50061 - DNA, 192 bp, Homo sapiens
gacgcgtgagctgcattctgaggagtgagtaggagtttgccaggaggagagtgggggtagcagcgctggcaggaggagcggcttgcgaaagggcttggcgggagaggaagagagaagctgagtgtcgcggaggctgagagggaggaggggtgagtgggttgtggtggagatgaggcttctggagggcagttt

SEQ ID NO: 50062 - DNA, 296 bp, Homo sapiens
  misc_feature (36)..(36): n is a, c, g, or t
  misc_feature (57)..(57): n is a, c, g, or t
  misc_feature (59)..(59): n is a, c, g, or t
  misc_feature (96)..(96): n is a, c, g, or t
cagcagcatggcacagtgaactgtgagacgtctggntgccatctggttctgccactnanttggtctgcttctttaagatagctgttgatccttttncagctaggtttcttcatctgtaaaattgaggactggaaacagggaactggagcccacaactctcaaaccagaaagcttagaaagaacctgtgccttctaacaagttggtatcaggtgaaggataggcaagtactttgcatttagataagttaggtaattctttcccctctaatgtaattcaagtaaaaacaaatagcaag

SEQ ID NO: 50063 - DNA, 263 bp, Homo sapiens
taaaaataacaaacatgaaatagattcatgaaaccccatcatattaggatctagaaactcccaatgtctaaattgccactactgagtagttgtgtttttgtaggtattgtacctcctttcactgaattgaataaatatagaatccatttactacagggagggcaaggcttctccttcaggatttaaaccgtaagtccctaaagacatttggaggaagtcttatctggatgcaggaggacagaccttgtgtttcagtatgattt

SEQ ID NO: 50064 - DNA, 613 bp, Homo sapiens
tattctcgtgatccgcgtcacaaacacaataaacttattcacttgtgtctctagatctaaatttgtacttgtatattttattcatttatttattatagatggagtctcgctctgtcgcccaggctggagtgcaataggcacaatctcgcctcactgcaaccttcgcctgctgggttcaagcgattctcctgtcttagcctccctagtagctgggattacaggtacacaccaacatgcctagctaatttttgtatttttagtagagatgaggtttcaccatgttggccaggctgatcttgaactcctgacctcaagtgatctgcccgccttggcctcccaaagtgctgggattacaggcgtgagccaccgcgcctggtctgaaatatgttcattttaatccagcagaattcattgctgtttcaagatagaaccagatttggaaataaaattggaaggtggctatctgccaaaaatttcaagtgcctcttggccatgggtagcttattcaggaaacccaagtcttttaaggaaggacttggatttttttcttaatttcaaagaacgtttttgtgccaagggatacatatatgaggtctggggtacgagctcgaat

SEQ ID NO: 50065 - DNA, 570 bp, Homo sapiens
ggattataggcgtgagccaccttcccggctatttttgtatttttagtagagacggggtttcgccatgttcgccaggctggtctcgaacttctgacctcaggcgaccctcactgcaaccttcgcctgctgggttcaagcgattctcctgtcttagcctccctagtagctgggattacaggtacacaccaacatgcctagctaatttttgtatttttagtagagatgaggtttcaccatgttggccaggctgatcttgaactcctgacctcaagtgatctgcccgccttggcctcccaaagtgctgggattacaggcgtgagccaccgcgcctggtctgaaatatgttcattttaatccagcagaattcattgctgtttcaagatagaaccagatttggaaataaaattggaaggtggctatctgccaaaaatttcaagtgcctcttggccatgggtagcttattcaggaaacccaagtcttttaaggaaggacttggatttttttcttaatttcaaagaacgtttttgtgccaagggatacatatatgaggtctggggtacgagctcgaat

SEQ ID NO: 50066 - DNA, 418 bp, Homo sapiens
aacagatatgtatatatgagtttaccaaaaggaatgtactagaatgttcatggtagcactattcacagtatccccaaaatgtgaactacacaaatgctcattgttgtggactgaattgtgtcccccaaaattcacaggttgaagcccttaccccagtggaactatatttggagatagggcctttaaggaggtacctaagattaactgaagtcataaggatagggccttaatccaataggactggtgttctcataagaaaaggcagagaccccaggagtgcgtgcacacagaggaaagaaaggccacatgaggacatagtgaaggcggccgtctgcaagccagaaagagagccctcaccaaaaatcgatcctggcagcaccttgatcttggcctctagcctccagaactgtgtgagaaa

SEQ ID NO: 50067 - DNA, 617 bp, Homo sapiens
tctctgttcacttgccaaaaacaaacaaaaatgacctcacttcagacacagggataaaagcaggaggaaattgctatagttagaacactataggttttttttccccctgtactttttggatacatatttttaaaaaaataaataggatcacttactctggcctagcacaatttcatctaaagtgttttgaaagttatagtcttaattttagggacagaataggttatcgtaaggggtgtgagggtttttaaatgcaaggcattttccaggggacttttaaaaatcaataccaggaagcaaaataaaaaatttaaaaatcaaaacccagcagggcacggtggctcgcacctgtaatcctagcactttgggaggccaaggcaggcagatttcttgagcccaggagttcgagaccagcctgggcaaaatggtgagatctcatttctacaaaaaaaaaaaaaaaaaaaaaagcaaaacacacacacacacaacaaaattagccatgcgtagtggcacacatctgtagttccagctactcaggaggctgagacgaaagttgcagtgagccaagattgcaccactgccctgcaacctgggcaacagagtgaaaccttgcctcc

SEQ ID NO: 50068 - DNA, 190 bp, Homo sapiens
caggagaggagctgtctttgcaaagccccctcgggtctgggaattaagggcttctgctgccgacttccaccctgcagcccttcaaaaagtgtcatcactgccaagtgcaattccaaataaagagacgccttcgcagagccacctgcgggttgagggaaagctggaaggctggggggcatcactgcgaggc

SEQ ID NO: 50069 - DNA, 1040 bp, Homo sapiens
aactttttttgtaaaggagtaaattttttaggctttgtgggccatgtaagttctctgttacgtatccttatgctcatggactatataaaaacactctcctatcccaagttggcccacagaccatggtttgcagactcctgattaaagcctaatcaatagcaaataaaacaaaataaagatacctattctagagaattagataatcctcaggtgagtcagttaaacagtgtttcatcatgtcattcaatggacatgtgttcttttggccatttgcaggttttgaatatgggagatacatatttatatatttttgagggcagggtttcattgtcacccaggttggagcgcagtggtgcaaacatggctcactgtagccttgagctcctgagctcaaacaatcttccttcttcagcctcccatgtagctgaaaccaaaggcatgcaacaccacgtccagcttttaaaaaatgttttgtagagatggggcgtcactttgtggcccgggctggtctcgaactcctgggctcaagcgatacttctgccttagcctcccaaagcattgggatcgcaggcataagccactgtgcccagctatattatttttttcctaacaaagatgccctgctggagggagctggaggggaaacagtgagggagaatgtgaaggaatttgaagaggtagggccttgtgggtgggatagcccacacctaacctcttttcctaggggctgcccctggtttactggtataaaaattaatcactctcttttcactctcagagtgtcccagtttggatgatacatgataaatgggtcacgttaagaagtttgctcctcaacataaaattaataggaagggttgacaaattttaaactagtcaagtgtgatataatcagatttgcattttgaaaggatgactgccttgttggtaatggatttgaggcaaagacacaggggatgttaaatggttgtttaccaggaaatttgtctttcaggttaaacaatttgttaaactttctcaatagcaagttaattttgaaa

SEQ ID NO: 50070 - DNA, 724 bp, Homo sapiens
tctgtttataaatattttccataagaagaaagcaaggaataatcttctgacactgtattgtaaaaaaatctttgtctcttttccttttatcttccctaggcatagagattttatgagaatgttttggcatcaaggtttttcttggaatttttgtggggtgatgtgtcctcagccaccctttagtttttttcctggtcctgggttccagtactgtctgtgaataaaccaagatatcagtcatggctatgtctgcaagactgtctaatgaatattaattcctggggtcattttctcccataggacaacctgtggtatgggagtgtagcctctgaagggagcaggtgtattccctggggctgagaggaatctcctggtgtacttttcgtttgaaaagctaaccccttcagatgttaagactgtgttcacccagcccgactttcctttctttgggccacattgctggtcacccaatcaaatgctggtattgagttgaaaacaaataatttctgaccccttgattctctacaatttgtgaaaaaagactagtatctctgccaggcacggctcccggcttgagttagatcttttaaaagtaggaattcagggactacagccacctcagtcgaattgcctaccacttaactattttcactccctacacaaaactgatcttcccctgcatttttcacaggtgtcctaagcagggtctcaaatctactcccac

SEQ ID NO: 50071 - DNA, 1579 bp, Homo sapiens
  misc_feature (1578)..(1578): n is a, c, g, or t
gacggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatgggaccattgacatttacagatgtggccatagaattctctctggaggagtggcagtgcctggacacagcacaacagaacttatatagaaatgtgatgttagagaactacagaaacttggtcttcctgggtattgctgtttctaagccagacctaatcacttgtctagagaaagaaaaagaaccctgcaagatgaagcgacatgaaatggtggatgaacccccagttgtgtgttctcattttgctgaagacttttggccagagcaagacataaaagattctttccaaaaagtgacactgaggagatatgataaacgtggacatgagaacttacaattaagaaaaggctataaaactgtaggtgattgtaagctatacaaaggaggttataatggacttaaccaatgtttgacacttacccagagcaaaatgtatcactgtgatatatatgtaaaagtcttttatgcattttcaaatgcagatagatacaagacaagacatactggaaagaaacctttccagtgtaaaaaatgtggcaaatcattctgcatgctttcacaactaactcaacataagaaaattcatattagagagaatacctacagatgtaaagaatttgcaatgcctttaatcagtcctcagcccttactaaccataagagaatttatgttggtgagaaacactacagatgtgaagaatgtggcaaagcatttaaccactactcaacccttactaaccataagagaattcattctggagagaagccctacaaatgtgatgaatgtggcaaaacctttagcatatcctcaacctttactaaacataagataattcatactgaagagaaaccctacaaatgtaaagaatgtggcaaagcctttaaccggtcctcaacccttactagccataagagaatacatactggtgagaaaccctacaaatgtgaagaatgtggcaaagcctttaactggtcttcaactcttactaaacataaggtaattcatactggagagaagccctacaaatgtgaagaatgtggcaaagcttttaaccagtcttcaagacttactcgacataaaaaaattcatactggagaggaaccctacaaatttgaaaaatgtggcagagtttttacctgttcctcaacacttactcaagacaagaaaattcatactggagagaaaccctacaattgtgaagaatgtggcaaagtttttacctattcctctacacttactagacataagagaattcatactgaagagaaaccctataaatgtaacgaatgtggcaaagcttttaaccggtcctcacaccttactagccataggagaattcatactggagagaaaccctacaaatgtgaagaatgtggcaaagcctttaagcagtcctcaaaccttaacng

SEQ ID NO: 50072 - DNA, 1325 bp, Homo sapiens
gacggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatgatggagtcttgctctgtcgcccaggctggagtgcatggcaccatctcggctcacagcaacttccacctcccgggttcaagtgattctcctgcctcagcctcctgagtagctgggactacagatgtgcaccaccacgcccagctaaatttttatttttttatttttagtagagaaagggtttcactgtgttagccaggatagtctcgatctcctgacatcgtgatctgcccacctcagccttccaaagtgctgggattacaggcatgagccatcgtgcccagccctgtattatatctttatctttatcaagttgtggtctaagtgagcatttggtatgattttgggattattgaatttgctgaggattgttgtgtttctgattgcgtggtcaattttagagtatgtgacacatggtgatgagaaagatatatatactatgttggtttcagatgaagagtttcatatatgtttattagaatgatttggtcaagtgttgagtttaggttctgatatctgctaattttctgcctcaaggtgggaaattaaagaaaataaaattaaattaaaaagagaaagaaacaaggtttcctgtattaggctgacttatcctagaggcagtaacaggcacagcccacatccaggaaaagttttgataacactatttaagaagccagggctggaaagaatgtgctctggagactctcccagcattccctcaacatagggagaagagaaacaaattttcctttctcttatgattcctgtttttcatttaagcagcacattgaaggtcatgagatgcctgagcaggcctggattgcagccacctaggcaccatagtgaaggttataagataagcccatgcaaggcactagagcaagcctaggtaacagccatctgggccacatagtaagagtcatatgtaagtctgagttataaacctgtcatagtatgattaactgcttttgttctgtttctgtatccttgctttcacatcactacactttgtgccactgtaggcttgtttcaagttagcccaccctctttagaagtgtatgtaaaagttaaatgctgtctttgtccttggcccagtctctggatgttaatccactgggtctgagtgcactcaataaaatcctccttttctacct

SEQ ID NO: 50073 - DNA, 1105 bp, Homo sapiens
gacggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatggtgagagtgccgagtctgacatccccagagagggggaggggctggtcggaaccgtgagaagtggccgtggcggacttaggtctcccggcagtcagctccacaatctgcgcccggaattctccttgcccagctcggcttcagtccccttcagccataagatggcgactgtgctgacagccgggccccgggcgtcctgtcttccctccgcagtgactgtgcctgacgtgtagccctgtctggggagctctgcacgcgcaattccgcagtctctcccagattgtgcaagaaccatgggaggggcgtcaggcatagagattttatgagaatgttttggcatcaaggtttttcttggaatttttgtggggtgatgtgtcctcagccaccctttagtttttttcctggtcctgggttccagtactgtctgtgaataaaccaagatatcagtcatggctatgtctgcaagactgtctaatgaatattaattcctggggtcattttctcccataggacaacctgtggtatgggagtgtagcctctgaagggagcaggtgtattccctggggctgagaggaatctcctggtgtacttttcgtttgaaaagctaaccccttcagatgttaagactgtgttcacccagcccgactttcctttctttgggccacattgctggtcacccaatcaaatgctggtattgagttgaaaacaaataatttctgaccccttgattctctacaatttgtgaaaaaagactagtatctctgccaggcacggctcccggcttgagttagatcttttaaaagtaggaattcagggactacagccacctcagtcgaattgcctaccacttaactattttcactccctacacaaaactgatcttcccctgcatttttcacaggtgtcctaagcagggtctcaaatctactcccac

SEQ ID NO: 50074 - DNA, 895 bp, Homo sapiens
gacggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatgtgactgtgcctgacgtgtagccctgtctggggagctctgcacgcgcaattccgcagtctctcccagattgtgcaagaaccatgggaggggcgtcaggcatagagattttatgagaatgttttggcatcaaggtttttcttggaatttttgtggggtgatgtgtcctcagccaccctttagtttttttcctggtcctgggttccagtactgtctgtgaataaaccaagatatcagtcatggctatgtctgcaagactgtctaatgaatattaattcctggggtcattttctcccataggacaacctgtggtatgggagtgtagcctctgaagggagcaggtgtattccctggggctgagaggaatctcctggtgtacttttcgtttgaaaagctaaccccttcagatgttaagactgtgttcacccagcccgactttcctttctttgggccacattgctggtcacccaatcaaatgctggtattgagttgaaaacaaataatttctgaccccttgattctctacaatttgtgaaaaaagactagtatctctgccaggcacggctcccggcttgagttagatcttttaaaagtaggaattcagggactacagccacctcagtcgaattgcctaccacttaactattttcactccctacacaaaactgatcttcccctgcatttttcacaggtgtcctaagcagggtctcaaatctactcccac

SEQ ID NO: 50075 - DNA, 620 bp, Homo sapiens
gacggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatgggaccattgacatttacagatgtggccatagaattctctctggaggagtggcagtgcctggacacagcacaacagaacttatatagaaatgtgatgttagagaactacagaaacttggtcttcctgggtattgctgtttctaagccagacctaatcacttgtctagagaaagaaaaagaaccctgcaagatgaagcgacatgaaatggtggatgaacccccagttgtgtgttctcattttgctgaagacttttggccagagcaagacataaaagattctttccaaaaagtgacactgaggagatatgataaacgtggacatgagaacttacaattaagaaaaggctataaaactgtaggtgattgtaagctatacaaaggaggttataatggacttaaccaatgtttgacacattcttcacatctgtagtgtttctgggtaccgag

SEQ ID NO: 50076 - DNA, 379 bp, Homo sapiens
tgttcacccagcccgactttcctttctttgggccacattgctggtcacccaatcaaatgctggtattgagttgaaaacaaataatttctgaccccttgattctctacaatttgtgaaaaaagactagtatctctgccaggcacggtggctcacgcctgtaatcccagcactttgggaggccaaggtgggcagatcacctgaggtcaggagttcgagaccagcctagctaacatgatgaaattccgtctctactaaaaacagaaaattaaccaggcgtggtggtgcatgcctgtaatcccagctactcaggaggctgaggcagaagaactcgggaggcggaggttgcggtgagccgagatcgtgccattgcactccagcc

SEQ ID NO: 50077 - DNA, 395 bp, Homo sapiens
aagcattggatggcacatttaaaaagatttgttttctgtttataaatattttccataagaagaaagcaaggaataatcttctgacactgtattgtaaaaaaatctttgtctcttttccttttatcttccctaggcatagagattttatgagaatgttttggcatcaaggtttttcttggaatttttgtggggtgatgtgtcctcagccaccctttagtttttttcctggtcctgggttccagtactgtctgtgaataaaccaagatatcagtcatggctatgtctgcaagactgtctaatgaatattaattcctggggtcattttctcccataggacaacctgtggtatgggagtgtagcctctgaagggagcaggtgtattccctggggctgag

SEQ ID NO: 50078 - DNA, 698 bp, Homo sapiens
tactaaccataagagaatttatgttggtgagaaacactacagatgtgaagaatgtggcaaagcatttaaccactactcaacccttactaaccataagagaattcatactggagagaaaccctacaaatgtaaagaatgtggcaaagcctttagcaggtactcaacccttactacccataagagaattcattctggagagaagccctacaaatgtgatgaatgtggcaaaacctttagcatatcctcaacctttactaaacataagataattcatactgaagagaaaccctacaaatgtaaagaatgtggcaaagcctttaaccggtcctcaacccttactagccataagagaatacatactggtgagaaaccctacaaatgtgaagaatgtggcaaagcctttaactggtcttcaactcttactaaacataaggtaattcatactggagagaagccctacaaatgtgaagaatgtggcaaagcttttaaccagtcttcaagacttactcgacataaaaaaattcatactggagaggaaccctacaaatttgaaaaatgtggcagagtttttacctgttcctcaacacttactcaagacaagaaaattcatactggagagaaaccctacaattgtgaagaatgtggcaaagtttttacctattcctctacacttactagacataagagaattcatactg

SEQ ID NO: 50079 - DNA, 336 bp, Homo sapiens
gcaaagtatttcatcatatgcatgtactgtaccttatttagccagccccattttgtttggcttgtggagaattacaatagctgttttgactgttgtatcacatgccaggcactgtactgtgtattatctcatgtaattctcatagttactgcatggtgtaggtatttttatccccagtttacaggtagagaaactgaacccagagatgttaaataatttgcccaagttttttggctgactatactgatgaagatactgatactagcattctgttgtcagttatttgccagacagaattctttattttttaatacataatatcatttactcttgaga

SEQ ID NO: 50080 - DNA, 316 bp, Homo sapiens
aaacaaacaaaaatcgtgggctttctgagaaaaggagaagtctatgttttaatgacattctgagtgagaaaacattccaaattgtattaaatgatataatttgtgtttctctcatccatctcatattaacctgcacagagatggagaaaaagttagccaatctagtactcattgtgatatctcattgacaaccaatcttgaggcatttgtcaaaaaagttactctaacagtaaggtgtaacccaaatcaaattaataagtaatttttgaagcattttttaatgtcaaaagacagtcttttattgcatttagcaaga

SEQ ID NO: 50081 - DNA, 535 bp, Homo sapiens
gtctgtcccaacattagtgcatactcaacagagctgccaaagtcctcttccgctgacacactttgagtcatacgacgcttctgctcagaaacctccagtggttttccatttccagcctagaaaggctagcatggaaaaccttccatggtcctgtcttcaattaaccttctttagcctcctcttccatatcacactagtgccccaaacataagctgtctcccagccaaacaggccaccacatcattccagaaatgccttgtattttcctgattctatgacatgacttaatctattcttaatgctcacttcaaacaccacttttctcaggaaggtttccgagagacaagtgtttatttttccccctatctaactccattgcgttaatttttgtcttatagtttccacatatggctttgcattcaagttacttttagacacatcttatccattcttctagactgtcatctccttgacaataaagactgtgttttattcatctttgtgtatccttccatgcttcactcagtagcagatg

SEQ ID NO: 50082 - DNA, 418 bp, Homo sapiens
cgtggttcctgttttgccacatctgtgagaggcgctgggaacggggacttgccttacacctctcggttaacaccctggagactgatggagttcagagcagggtaatttacagcccatccctccaatcttaattcactcgatgctcctttcttccttattgtattagtgtgacccaggtacctgccaacaataatggcctctccagctaggagcctctccccaactcccaggacaatttataccttttccttggattttccccccttaaattaaacaaaaagaggaaaaatgagaaaaggttagcatgggtttggagcactgaagcccccgtggttctgggcaggaagccaatggcctgagggcacacatgtgtgtgctctcccagaagggccttcaccggccctgttttacagccacc

SEQ ID NO: 50083 - DNA, 509 bp, Homo sapiens
aaatacccaaggtgatgaataccccaaacaccctaacttgatcattacacattctatacatgtagcaaaatatcacatgtgctctgaaaatatgtaaaatatgtatcaacaaaagtttttgtttgtttttaaagcagcctataaacagagtgtcattttctgaatactaaagatattccttttttatgcatctggtaagtgggcttctttttattctgcagactgatgctctgcctttcccaggatgccacgatgatgaagagtaaccaggatacatttagaaaaggtgcctctccggggcccagagctgttgccaaggcgcactggtgcattcggcacaaagcggtgcgggcagaaattaacatggtctgcatcaggtggaggctgtgttaattttccctgtgcactgactgtctaacctaaacatcccatggtggaaacagaaccattagttggtatttctagggaagggacattgagcctcagatgggttaaaacaatatttgcaa

SEQ ID NO: 50084 - DNA, 404 bp, Homo sapiens
cctcaacaaaatacaggcaaatcaaatccaccagcataccaaaaagcttattcatcacgatcaagcaggctttacacctgggatgaaacgggggttcaacatatgcaaatcagaaatttgaggccaggtgcagtggctcactcctgtagtcctagcacttggggagaccgaggcaagaggattgcctgagctcaggagtttgagaccagcctgggcaacatggcaaaaccctgtctttactgaaaatacaaaaaactacccgggagtggtggtgcacacctttagtctcagctactcgggaactaaagcacgagaattgcttaaacccgggaggtggcggttgcagtgagcccagatagcaccactgaactccaggttgggtgacagagcaagacactgtctcc

SEQ ID NO: 50085 - DNA, 396 bp, Homo sapiens
caaaagagtggtgacaataggcacataactacagcatctactacggacctcgccatccagaagcagccagtctagtagaatagtggaatgggctattgaaagctcagctaagactccagctcaaggaaaataggccacaaagttggagcactctcctttgggcatgcaatatatgtgtagaactaacagctaatatatgggccccagtagttagaatacatgggtctgggaaaaaggcatggctttggccatcattactcccagtgaccttcttatggaatttgtgttttccatttgtacaaacttagaattttccaggcttagaagcacgtgttcccagagatcaataaggtttatgctgcacttaaaactgcagctgccacagggttactttga

SEQ ID NO: 50086 - DNA, 868 bp, Homo sapiens
agacccacagcatggtctctggggtcccacatcccaggtagagaatgacccaggtcgctggcgtctgtgccatctctgctccactgaccactcatgggggtcctggagatcctgacaccggtggccggggagcagcagcccaggcacaggccccagtgcacatgcagatcccaccgtgtctgcacaaggccttgccccaacgaggcctgggtgccgtgtgagggccgggacgctaacacagcggagggtacccacgcgtgagctgctctggggtccctccccgtgtttcttcctgtaatgaaacttgtacccaaatgggatatgcagggttgcactgtgcagtcgctgtgtgttttagggtctcatacccgtgtgcgccagcaggaccacagctgtgaccggctgctccagaagaagtgggtgggttgagaccccaccggcagggtcactgggggtagcaggccctctgtcagcactgacttctgtatcatgtcagggatttttagggcggcaagctcaggtggacaggcagttttattctgtttcccatgtcaagtccagccccagactgactttctgaggtcacagacggagcctcaccccatccaaggcggtgtcctggactcccactgtgctccccagagggcagggtgagtgcgtggcatccttttggcgggcgtgggtgcctctgtggacctggcgtgaggcttctctgtttctgagtctcctatggaccatctgtcttctgtgtggctgctgaggaatcacactggggtggccgtgccggtggctgaatgagaacaggacccccatgctgcacagccctgcttaacgcgggggtggccccagaagcgggtgggcgaggctg

SEQ ID NO: 50087 - DNA, 485 bp, Homo sapiens
aaagctctgcaactttattcaagatcacacaggggtttcattctggtcagtgggaaggagaatgaccaagaaggagccagtcagggaggtttgtatggccaggcctggatctggtacctgtgccttcctcttacattccattgattagctcattcatgtgaccacacccaactgcaaaggagtctggtaaatgtagtctatagctgtgcctaagtagagggggaaaactggtttgggggaacaagttcataccttgttagctgtactgatgcaacatgacttagggacatttcaagtcttgtgattcaagtctcatgatttcaaggaacttgaaatttagttaagtcttattgttagtgagctacgcttttggacaagccccatcctctctctggacctagtcagtaagacgcaggacttgcaccaggtccttcctagatttgggactctctcatgcactctgtctttccctcctcagcatttcc

SEQ ID NO: 50088 - DNA, 423 bp, Homo sapiens
tactcagaaaataactccctgctacccttttcttaagcagttttcggcattcatgtttatcatcttacctggttttatatgctttgtattatttttgactgtttttatcttattttaataagatagttgttgttccatttattatctgcgttccctcccaccatccactgtgcccaacctccgtgtatcctccatgggagcccatttttcttcctgccctgggctcagtgtctggttcacaatctgacatgtaatgactgaatcatcaaatgagtgcaggaattcagggactgcgaatcaagtcatattagaaaaaatggttctccatttggaagaagatctctggtaagtttagaattagaaatattggctttattcttaagattcctggagaaagcaaggcaatcgtctttttttcatagc

SEQ ID NO: 50089 - DNA, 368 bp, Homo sapiens
gggggtgatgcagggaataagtacactaacctctctctcctttgccatctacattcctgctgggctgatcactggccaaatccagctgttgcaaagagggcagggctgcccagctaatgctatctgtagaagctgggcttctggggcacagagcaagtcagagacaggcagaacagggatgtgggtttggaccaaacactgaataaaccagatcaaggattcttctatcaagacaagtttatatacttgcagcttgatcccattgtttcccttagataactgtgcacttgtttttgtctgccctctttcctgtgtctacactcttcctgtcttattctatttacacatagctcagtcttttccaatta

SEQ ID NO: 50090 - DNA, 307 bp, Homo sapiens
caaggtttttattcctatactgaatatcatgctgagggagtatccatggggacagaattctaggacagcttaaaacaatcactccttaagctttggaagcttatcatctaaaacggaggctaatgggtgtattgggagggaaagaaagagaagcccattcctgctcctgacttgatgtgtgaccctgaaaaagtatagtgttctgtgggtctatccttgatctctgtaaaatgggaataatgttaccttcctcagaaagctctggtgggaaaaaagaaaaagtacagcaatgtctggcacattgtaa

SEQ ID NO: 50091 - DNA, 369 bp, Homo sapiens
agcccttattcttttttcatttgcattcccatggacatttatgtatttttttgcctaggaaagtgctgtttcttagtgtaataaataagtgttaaaagtagttctccacagctgtttcctggcccttgctatttctttcccttctctttttcttttaaaatgaagagggtagttaaaaagaaatagacatcagaactggaagttcactctgtaacttcagcaactaacacaatatgagtctgatgtgttaaatatttttcactggcgttggcaaaagcttagtgaattttgtaagagccattgttctgaaataagcatatattatagatatgttagcagaatacttgataaatcttatttgtggatatt

SEQ ID NO: 50092 - DNA, 1178 bp, Homo sapiens
ttcactctcctagaaacccaactagatccttcaccctctgacaccatggtaaactcctgttgtggctccgtgtgctctcaccaaggctgtggccaagacctctgccaggagacctgctgccgccccagctgctgtgagaccacctgctgcaggaccacctactgtcgccccagctgctgtgtgtccagctgctgcaggccccagtgctgccagtctgtgtgctgccagcccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgcctgcgtccagtctgtggcggagtctcctgccacaccacttgctatcgcccaacctgtgtcatctccagctgcccccgccccttgtgctgtgcctcctcttgctgctgagcccactgccctggctcatctctcccttcactgcaggcccacagttgtagaccattcttctgtgctgactattaggacacatggagtgggattgatgtcattcagcagggtggacttcatgtttccaatgagcccatcaccatcccactgactctgtgagaacattctggttcattttaaactccctcccttgctttctttctcttccagtcatggcaccaaatatgaaataatttgtaatccactagctaagaaattattccaatcctctaaattcctcattttttaaatcgttttgagcctacagaatatccttcccagtgaggtacacattatctccatttcaaacatattatttgtctgtcagcctttcagtcattcttttctcttggaaaggtaggaggctgcccctcccatgctctcctgctttctccctgttctctctttgtctctgtttgttcaagtttgccagaatttttctattttattggttctttatctttattgggttcacaaaatatattggattaaaccttttcatttag

SEQ ID NO: 50093 - DNA, 311 bp, Homo sapiens
cggaggaggagggggcagtgcctgcagagcaccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaagtcccgctggctctcatgtgctcgatgccatcctgaccagcccctctgtgacgcgcaagctgcgccgccgtgtgctgcagaacctaaagagggacaatatgtggctctggcctgtagtcgccatggca

SEQ ID NO: 50094 - DNA, 314 bp, Homo sapiens
cattcttttccaggtgacagagactagaacacatttcaggagacactttaagagtgaaagttttgcaggatgaaaagagttacagagatggatgatggtgatggtcacacagcatcatggacgtgtttaataccactgaactgtacccttgaaaatggttaagatgagtctcgctctgctacccaggctggagtgcagtggtgtgatctcggctcactgcaacctccacctcccagattccagtgattcttctgcctcagccttccaagttacctgggattacaggcgcctgccaccatgcccagctaatgttt

SEQ ID NO: 50095 - DNA, 255 bp, Homo sapiens
cgcgtttggtgcataaaatataatttctataacatgaatttgaactttatgtctttgtaaaataaatatgctaaatataacaaacaaattattatactataacttgcaaaattagaatttagaagtgattttggaagatgatttatgtattccagttctctgtaaattaatgagaaatgactcagtttgttaaattgctgaagttgtaatcattattgatttgtctttaactaattaaagactgtcctttaaggc

SEQ ID NO: 50096 - DNA, 107 bp, Homo sapiens
gtgtggacatagacaatagactggactggtgtggacgatggacagggttctgccgtctcctggggccctgagaggcacctactcatccagcccttgcagaccagcag

SEQ ID NO: 50097 - DNA, 368 bp, Homo sapiens
tctttgaagacacggtcttgcttgttgccctggctggattgcagtgatatgatcacggctcactgcagccttgacctcctgggctcaagcagtcttcccacctcagcctcctgagtagcagagaccacaggtgtgcaccacaacacctagctaatttttaaaatgtcttgtaaagacagagtctcactgtgttgcccaggctggtcttgaactcctggtttcaagcaatcttcctgcctcagccccacaaagtgttggaattacaggtgtgagccacgatggccagcctgccatttctaattagctttgtgcttggacaagttattccactgctctgtgtcatagtttccttatatgtcaagtggtgg

SEQ ID NO: 50098 - DNA, 1373 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatat

SEQ ID NO: 50099 - DNA, 718 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaaggcttcctggagtgtccggcaggtacctctccattcaagacgggtgtagctgtcgctctagagctctgtccataaccaagctgtctctctctcccctggctcccagaagatctcttgcccatccaacactacctgata

SEQ ID NO: 50100 - DNA, 1625 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagcaggagaccatgtcactgtggaaattgtcctcccagagccttccgacccctctgggcaggggaagagtggctcaggcagatagtgacctctgtgtccttctggacagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacatatctgtatgtatacatgcatatacatcaagagatgctttctggacttcttcctatcccccctcccaacccaaatttcccctataaaatctaccctctctccttcaccctacaataaggcggaattgcttgtac

SEQ ID NO: 50101 - DNA, 1518 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacatatctgtatgtatacatgcatatacatcaagagatgctttctggacttcttcctatcccccctcccaacccaaatttcccctataaaatctaccctctctccttcaccctacaataaggcggaattgcttgtac

SEQ ID NO: 50102 - DNA, 256 bp, Homo sapiens
  misc_feature (161)..(161): n is a, c, g, or t
  misc_feature (170)..(170): n is a, c, g, or t
  misc_feature (220)..(220): n is a, c, g, or t
caacgacgtgcagctccaggtagcggttctgacgcagggcagggaggtggccctcctggggggtgactctgacaccgaagaactcacacagcgtcagccagaagccaggggtgaactgcaggcctcggtgggcctgggagtgcagagcatcacggaaactntgggccccntcctcctggagcatttccccacccactggagggcggtagtcccaccacgnacacccttacgccatgtttccctccctggggtctct

SEQ ID NO: 50103 - DNA, 376 bp, Homo sapiens
aaagttaaaccaaaagaatatatgaagggcatataatgaagggatatctacaaagttgtgacagggctaatgggaagaacaggggatatgaggcagcccaagatcagcaacagtagtgatccagtgtcaccctgtgctggttatgaagatttagtctcttctatcttttccaataccgctttgctagccacctccccaaaccctaccaatagaaagcactggaggaagactagagggctggaaggatgtgaaaagatttcccactttgtttgttgacatcctcacagaatgggttcttcaacctggcagtggcagttgaatccagtaacagcagttggcttcagtttggagatcttccatgctcctaaaatcagcc

SEQ ID NO: 50104 - DNA, 527 bp, Homo sapiens
agatcagccagaagagggcttgagatcagttaccagacactgggggtgactgtcacactaagagcctttggggactcaataatactgggatacagtatttaggactggtatcctgttcctctgcccggtggggctcctattgactccctctgggtacagtggagttgcccctctgcccaggtgtggtggagcctagagagagtgcagtggatagggacctcacctcagcttgactgatattttgagctctgcacagtgtcctcaaacctgggacagaaaagatgagacccagacctcccaggagctcttggtcatagaggttactctctgtgtgtccttgccgtctgctgctttcacaatgggatagaattgggcagaattgggcagaattgggcagaatgttatttttggctgtggtgagtacagtgctgcctcactggacccaagcccaagctgcccgttaatttccagcagcttccagcccaggcattcaggccactgaggatgaggggagagaccatggttcg

SEQ ID NO: 50105 - DNA, 813 bp, Homo sapiens
tgaggaaatggaaactgaagcatgttgtacatacattttgtgtgagaagaacctgcaaggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaagtacgtagtaaataatattggttcaatgtgaagcactaagtacacagagaaatgaaaattgtgtccagtcccaaacgagaaatctgggatcgcaggcaaaaaggcagcaattaaattgttgccatgggattactgtatttgaaatcagcaaaatattgttttataatatgatttgtgagttttcagttttatgtcttttatttggtttgctttattttctcttgccaactacttgttcttctgataaagaacatctctctctcttttttttctaatgtatacctttttggtttggttttgagtgatttaaaagaagaccccgagaatggacatgtaatgaatcattgaagtgatggggaacagagacattgaccaatgttgctctctgagcttcctgcagatatcagctgt

SEQ ID NO: 50106 - DNA, 4195 bp, Homo sapiens
  misc_feature (1470)..(1470): n is a, c, g, or t
agcggagtggattagtgaccaggcaggattccagaggcctttccttcccacttccaccttgaattccaacttaaaatgcaagccatgtacagagaatgaacagagggccagaaatgtgctacgcttgcctgtgtataacgtagggctaggtgctgtctcccatgatttcatttactcaaaggaaatcagatttgagggagataatgtaatattttgtcttgtttcagagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttctatgtatcacttggtgaggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataanaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaaaaaaaaaatttggcttgtcttaaaaaa

SEQ ID NO: 50107 - DNA, 4077 bp, Homo sapiens
  misc_feature (1352)..(1352): n is a, c, g, or t
cgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttctatgtatcacttggtgaggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataanaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaaaaaaaaaatttggcttgtcttaaaaaa

SEQ ID NO: 50108 - DNA, 1938 bp, Homo sapiens
atggactgtggagccagaggagtagaaggagcaatggaaacctggcaggaagattctctggcaacagatgatttccttgtagactactttaatgaattcctaagccttccatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaaaaaaaaaatttggcttgtcttaaaaaa

SEQ ID NO: 50109 - DNA, 4041 bp, Homo sapiens
  misc_feature (1316)..(1316): n is a, c, g, or t
cgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataanaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaaaaaaaaaatttggcttgtcttaaaaaa

SEQ ID NO: 50110 - DNA, 794 bp, Homo sapiens
agcggagtggattagtgaccaggcaggattccagaggcctttccttcccacttccaccttgaattccaacttaaaatgcaagccatgtacagagaatgaacagagggccagaaatgtgctacgcttgcctgtgtataacagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgacgcaaggtattacacgtggatcacacccgcacacgcacttccagcatttctgcgaaacagtgatcgtcaccttgacatacagcgttacgccacatgggtctcacacagtaagacactggagccaagtccggcctgcaatttcaacacgtacggatcaacactttttctccccggactccgtgcacaaaacacgcatcccagtactaagcaaagcctccctggcccaactggccacgcacagaaaactctaggtaattcatgacacacagtacctactgtattccaattggctgaatggcttccctatacctcaaacgcagcacatcg

SEQ ID NO: 50111 - DNA, 4050 bp, Homo sapiens
  misc_feature (1325)..(1325): n is a, c, g, or t
agcggagtggattagtgaccaggcaggattccagaggcctttccttcccacttccaccttgaattccaacttaaaatgcaagccatgtacagagaatgaacagagggccagaaatgtgctacgcttgcctgtgtataacgtagggctaggtgctgtctcccatgatttcatttactcaaaggaaatcagatttgagggagataatgtaatattttgtcttgtttcagagccaccaactattacagaagaagaatttgaagattctctggcaacagatgatttccttgtagactactttaatgaattcctaagccttccactaggtctctggacccattatggaaattagattgacacaccaaagctcctgctccctttccaagaacaagcctgagcaacaccacaggatattcaaggagttcttgtttgaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataanaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaaaaaaaaaatttggcttgtcttaaaaaa

SEQ ID NO: 50112 - DNA, 332 bp, Homo sapiens
ggaagggtgaaaaaaagcatttacattttgtccttggttctcacccatttatgctttgggaaaatcattccctgtcccttgcttgccaagtgtgtacacggtaaaaccaggacagggtaagagccctgctagtataaggttttgtttggttttttgaggcaggttctatcacccaggctggaagtgaaacgccgtctcgaaaaaaaaaaaaattctcaacaattagacaatatatagaactctgtacacagcaaagataaagaaggaagtcttttcaagtacacgtttacagccataaagcaagcctcaataaaatccaaataaccagtatc

SEQ ID NO: 50113 - DNA, 306 bp, Homo sapiens
ggagatcgagaccatcctggctaacatggtgaaaccccgtctctactaaaaatacaaaaaagtagctgggcgtggtggcaggcacctgtagtcccagctactcgggaggctgaggcaggagaatcgcttgaaccctggaggcggaggttgcagtgagctgagtttgcgccactgcactccagcctgggtgacagagcgagactcagtttcaaaaaaaaaaagttcttaacgctatcaaaaaataacttggaaaccactgtggtgtacataaaagtggattttccttgcagtaccttctgcaagtgg

SEQ ID NO: 50114 - DNA, 629 bp, Homo sapiens
ttcctccattttaaaattttattctagttaccacattgttcttgcaattgcttggatttttcagaatagtaataaataataacgggaatcctaggcattcgtgtttttctatgtttttaacaggattttctctaatgtttcgctattaaataccatgcaggaaattgggaaataatatcacaacccaaggtaaatggagctaacagcatagatgggacaagctaagacatgaggaccagcttgcgactccagacctgggaagaccccatgagaagcaggggagagggtgggggcagtcatgggcaggctgggaaactccctctgctcactgagcctgtgggagcaggcccctggagaccccaggtttcacatagtagccacacgaagcagaaaagtcagaagcacagaaggcttcttcccaaggtggtgtggcaggcccaggaagcaggtggcagggccctggcatgaaggccagccagagagcagaacgccaaacaccagcccctggggttccactggcatcaccagtcccgccgtgctaagtggaattttcaggtggaggagagttgggaaaggatagaagtgatatgctatggaaatccttacattgtatgcctctgtgccgaaat

SEQ ID NO: 50115 - DNA, 627 bp, Homo sapiens
tgttttcatcagaaattagaatttaactttggtcaatatacaaagctgttgataaagtaaggcatacccatgtagagtatttattgacagctatccaaacaatcttacattttttccttcatgtttttcttttcaaagaggcagttttattttgctgcattgttactgtaatttcaaactttatagtttaaacctgttttttcatgtctttccatatccctttaagtctaaattttatgtccttacctgatttccctctgaaaaatgttttccagagatgtagtgatattgtgatattaatgctaacccaaatgttaatatgccattcatttgagaaatatatttgagagtcttctgtgtgctagtgtgtctggaattggtgggttcttggtcttgctgacttcaagaatgaagccgcagaccctcgtggtgagtgttacaattcttaaagatggcgtgtccggagtttgttccttctgatgttcggacgtgtccaaagcttcttccttctggtgggttcctggtctcgctggcttcaggagtgaagctgcagaccttcgcagtgagtgttacagctcttaaaggcggcgggtctggagttgttcattccttccatctggagttgtt

SEQ ID NO: 50116 - DNA, 929 bp, Homo sapiens
tttttttttttgagatagtcttgctctgttgcttaagccagagtgcagtggcgcaatctcagctcactgcaacctccgcctcctgggttcaagtgattcttgtgcctcagcctcccacgtagctgagattacaggcttgcaccaccatgttcagctaatttttgtatggtaaagacggagtttcaccatgttggccaggttggtctcgaactcctggcctcaagtgatcctccccctgcgctcgcttcagcctcccaaagtgctgggattacaggtgtgagccaccacgcctggccaagagcctcactcctgtctttagtgattgcactgaagcaggcctcatttttttgcagtcatgctaaccacaagttagtcaacattcactaattgacattcattagaataggtctccaaggtgaggcataacgttggggtgtaatctggatttcgcagtcatctttttggggaaactgaaagtaccatctcatttgcatgaagtgactccacactggccctgtatatggactctggtaaaatgtgagtgtggtacagaggaaataggtaagacccccttatctagccctctcggcagcagcgggggggtgttacaaaggactagctgttcaaatatcttttgtattgtattgattcccctattgaatataaatatttaaagtataataactatactgtaggtgggcttatgagtgttctaaatatctaatagctaaattgaaataagtagaaatataaacaatttagcagctttctgtaatacatttacactcaaattataagcagctaattctaaaaaagatgtcactgtaaactattgagaactatagtattttatatataattatatgttcatgtatttgaacccaaaataattttaactgaaatgctttgaataaagtatactgtaaata

SEQ ID NO: 50117 - DNA, 1193 bp, Homo sapiens
tagtgattttagtaagagtaagttcagtgcagtgatgacaatagaatgcagattgcagttgctagaatataaacaggaaataagaagataaagacaactcgtggaataccttttcatagagcttaggtaaactgtaggaattattctccttgtactctaatacttattatgggttttatttataattatagtgtaatataatggatgagtgcatgggcttccccacttagcatttgttaagcattaacttaacattaagcattagactttgggcaagttgcttaatctttctaaacctcagttattttatctataaaatggcgataaaataatacctacctcacgaaggtgtggtaaggattaaagtgaaaatgtagagagcaggtagcatgctttgaacacagttcttggcacagaaagtgcccaataaattgttagtttcttgtagctattacatgccaggtcctgtgctaactaagcgctttatatgcattgtctcttggactcattggaagacctactgttttaattttggctgctgataaaactgcatcacagagaggttacctaatttgccccaaggtcacaggacaggactagtaagtggtcttggttcattattgtcaaatttactaatcaccttgagaaaaattaagattggatggttgccttattttacaacttagaagatgattgaagacattttggtgcaggtggggagccagattgcaagtagcctcagtgagttgtgtgggtgagttaagcaaccttttttattctttttttttgagacggagttttgctgttggtgcccaggctagagtgcagtcacagcttactgaaacctccacctcctcatttcaagcgattcacctgaactcctgaccttaggtgatctgcccgcatcagcctccccaaggtgctgggattacaggcgtgagccaccatgcccagctgagttaagcaatctttatgtagagctctcctttgagaaagaagttggttggttcaaagaaagataaatgggacagtggcttggaagaggtaatggaggctaggaaggtgtttatcaacaaaggaagatgtaggctgggcgcagtggctcacacctataatccccacactttgggaggctgagatgggaggattacttgagcctaggagtttaagaccagtctgggcaacatagggtg

SEQ ID NO: 50118 - DNA, 336 bp, Homo sapiens
gtgcgtaagtacggcgcagtggctcacacctgtaatccccacactttgggaggctgagatgggaggattacttgagcctaggagtttaagaccagtctgggcacacattatggagatgtagagctctcctttgagaaagaagttggttggttcaaagaaagataaatgggacagtggcttggaagaggtaatggaggctaggaaggtgtttatcaacaaaggaagatgtaggctgggcgcagtggctcacacctataatccccacactttgggaggctgagatgggaggattacttgagcctaggagtttaagaccagtctgggcaacatagggtg

SEQ ID NO: 50119 - DNA, 310 bp, Homo sapiens
ggcaaatgtgaaagtgcttgagacacagagagcaggctgccactcatgttatcagggctgttagcttcagcagcaccactggggagccctgtgcactactgagcctgtcctaccactcaactcggccagatactaagtctatggtcaggacagcactttcagcaacatcagatggggtgtgggcctggacatggaaaagggagaagtcagaacaaagctgtgtctcagagaactagatttgtttttgtttttaaaaaggctaagtaggaagagttggagggacatgcagactcctttttggctagaactc

SEQ ID NO: 50120 - DNA, 477 bp, Homo sapiens
ctgatgattaatatatgcttctatgttaacagtcttggactttattaatggtgggtggaagttaacttaatgtatgtatgcaaactaaaaagtggcatccttttcattaatgacccaaccattattcaagagctatgtctagttagggacttcagacttttgaaagaaatgaagaaataatgccagatacatgggctcgcacttggaatcccagctacttgggggaccgaggtgggaggaccgcttgagcccaggagttcgagaccagcctgggcaacatagcgaaaccctgcctcagttttaaaaaagaaaaaaagaagtagtgaagaaattggaaaggattctgagaagaaatatgcaaggtggaaaagagcctagaaagaaaggtgacagatgctgggatttggtcgtcagaagagatatctaggaaatagcatggcagccctcaagtactagctccacttaaagaaaaaaaga

SEQ ID NO: 50121 - DNA, 521 bp, Homo sapiens
tgctggggactatttggtcacgtgaaactctgcctggttcattcgcacatccggaagccacttcacggggggccgtcgcaaccggaaccacacacttggcatcggcggttgagccaaatggggactcgcggtgcaagcaacgctccccacgtgttagcgtgcgtgagattcagttggcggaattttactaggtgcgtgttggtagagtggggctgaggttctctttctcctgtggatgtatacgaagtcaaaggtcctgcccagccgtgcggtcccctcagtcaactctgtttcggagacataacgatttggattgctaacaagtcaagaaatgttcaagcccttggatgtagggaaaagaaagagagatcagactgtcactgtgtctatgtcgaaagggaagacataagagactccattttggaaaagacctgtactttaaacaattgctttgctgagatgttgttcatttgtagctttgccccaggcactttgccccagccgctttgacccaacttgga

SEQ ID NO: 50122 - DNA, 804 bp, Homo sapiens
cctcattaaacaaaaccaatgcaaggaccgctcctcagtggagcagattgctttttgaggtagagaacattcaagcagctgctagattgatttttgtactgggttagttggcattttcactaggagtgaaaactgtgagactaaacagtttaatttacttagaatgtccctctttctctctgtgtgtgtgtgtgtgtgtgtgtgtgtgtgtgcccgtgcgtcgggggggggggcagtggtgattctcaactttctaggaatttattaagtaaagtgtttagaaatggaaggaaacaattagataattctcagtgctccaggattttaggctcctacatttgaaaatacttgctgtcattaattgtcttgagatttaggcttttccacttttcaggaaatctagtagttttttgggggttttgttttgttttccttggttctgccctatgccaacctgctagtttccctttttattttagcctgatgaatcttcccttttgctttcagtactaaccattgctggtagttcttaacaggtctagcttttaccaatattgtcaagttagcaatattagctcctggggccctagtactctgtacttccacccctctccccaccagtaccatgctgcctgttcacatgatggacaccagctctgatattcaccctaagatataatccataagatgacaaacttgtattcaacaccgactcctactctggctaaaatgctgaagagaatactaagaaataggggatatggtcctggtcatcaagttgcttagtctgataggaaaaaaaaa

SEQ ID NO: 50123 - DNA, 747 bp, Homo sapiens
ccataaacaaccctgcttcaaagagtagaaatatgtttcataaaagccattacccaaagacgtataaaaggtaaaacttaaataaaaatagattaccatttacaacttggaaaagaaacccagaattttctgtagccactggtcaatgtgttcttacagccgtaaggcagaataaaaatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttcttatgtatgggccaattctgcttatatggacacagtgcaaacaggtacgacaagatattttcttcctcaaggatgatacctagcagataaagactgatttctaattcagtattgttacaactgcaggtgtgtgacccgtagcgagccactaaaccattctgaatctcacttccttcactggtaaaatagggaaaaatattagttgcctcatagagttgtagtaaagattaaatgaatgatctatgtaaaatggaagtgcttgataaactttagtctattattaacaccaaatactaaaaaaaaaaaa

SEQ ID NO: 50124 - DNA, 541 bp, Homo sapiens
atttatgaaacaggctgaggggaaataaagtaccctagtttgtagataataaaagctaagagtggtgcatccagggagagaggtggggtgccaggggttcttaggaaggtagtggtaccacctactgccagagtctcttttgaattggctttatccaggagtcccaaaagccctttaaactacttcatggtagcctttgacagagaactctttggcagtgacttggagagggtttatgaagacagtgctcaggctttggtcatgacacaggcagattggggatggagtggtacatgtttgattacagtgtgtgttgaggggcaagggggcaggtcttggtacaatgacaactagcacgagaccttgaactcaacatggattttaaaagtgtttgtttaatgcatgaataaaacaatgctcatgatattttgtggtctttagtgaccaatcatagtagacgtcttagaattaccaagccctaaggaatactaaaacccagtctaataaactcagtaaaaccaagagtggactctaatgtaaa

SEQ ID NO: 50125 - DNA, 721 bp, Homo sapiens
  misc_feature (1)..(1): n is a, c, g, or t
nttcggcacagagctcaatgtcaggtgggctttctccttgtggtgggtgccacagctccaggctgtcatattcatagcttctagtccagtgaaaagaaatcactaagtgtgctgatgagggtcctagaactaattctcattggcttaactttgatcatgtggccatggcactgcataacccagttggattatgcctgaattatgtgctcacttttggagctagggagagagtcagctccatatagactacatagactgggttcacatgggtcacatgggctaatgaagaagccaggggtttgagtccaggactgtctgattgccacttgttcttaggccacttcttctacctgccttcagtgttagaaaacaaatggcataccgatccacagaatatttgaaaaatagagagcttgctttggcagcatgtatgctaaaatcggaaggatacagagaagattagcatggcccctgtgcaaggatgacatgcaaatttgtgaagtgttccatatttttgaatagataatgaatggatgctgggctaaatacctaggtgatgggatgatctgtgcagcaaatcaccagggcacacgtttacctatataataaacctgcatatcctgcacaggtacccctgaacttaaaataaaagttgaagaaaaactaaaagaaggatggaggagggactttatcattcaaaaatatcaatgtcatcagagaa

SEQ ID NO: 50126 - DNA, 1899 bp, Homo sapiens
aggctggtactggcccgagtggttatgatgactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcacagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctactttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggtttggac

SEQ ID NO: 50127 - DNA, 2329 bp, Homo sapiens
tgctgaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgtccttgtcagtaggaaccctgatcctcggcctagattcagaggcttgctctcttaaggagagcctacctcttttcaaaattagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcacagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggtttggac

SEQ ID NO: 50128 - DNA, 790 bp, Homo sapiens
agcggcttctggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcacacaggaacagtgaaacttgcagcctgtgcgacgtttcagtctcggtctctgggttcccgcc

SEQ ID NO: 50129 - DNA, 1604 bp, Homo sapiens
aattgagaatcaaaggctttaatggttgctttgtgttgtcttcccccaaaaggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcacagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggtttggac

SEQ ID NO: 50130 - DNA, 1915 bp, Homo sapiens
agcggcttctggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcacagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctactttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggtttggac

SEQ ID NO: 50131 - DNA, 1861 bp, Homo sapiens
agcggcttctggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcacagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggtttggac

SEQ ID NO: 50132 - DNA, 1792 bp, Homo sapiens
aggctggtactggcccgagtggttatgatgactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcacagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggtttggac

SEQ ID NO: 50133 - DNA, 291 bp, Homo sapiens
ttccagatgtacaaaaacatataatgattattatacccactaacaccacgtgcttactacccagtctaagaaatggagcagggccgggcgcggtggctcacctgtaatcccaacactttgggaggccgaggtgggtggatcacctgaggtcaggagtttgagatcagcctggccaacatggtgaaaccccgtctctgctaaaaatacaaaaaatgagctgagcgtggtgactcaaacctgtaatcccagcttcttgggagttgaggcataacaatcgctcaaaccctggag

SEQ ID NO: 50134 - DNA, 1986 bp, Homo sapiens
tattttcttttagagacagagtctcactatgttgcccaggctggtctcaaactcctgggctcaagcgatcctcccacctaggactcctaaagttacaggtgtgagccactgtgcttggcctagaactctgtttttggcatttctttctaaatgagtacattggaagaacatttaggtttccaggctcctcataatttctgaatgggacccgctctgctctgcctctgaaaggaggagaaaaggctgagggttcaaagacagaaaagtcaatgtagcagaaatttgatttccttcagatggacatagtctgaaagaaatctatccagctgttctctatggtgcttatatgatgggtgacagctgtccccatctacctgtccctggcactgtgccttcacactggtcactgtgaaaagcagatcacactggactcagaggccagaatccaggacaagatcccccttctcatcttgagcccatcacatctttgtatagctgttaatgtagcatttacttctctatgggaaactcttgggtttttaacccaagaagaaattgtaaagcatttaaactagtcagaaaataagattctgatggtagcgatcaaataaaggaaaatttcacttcctctcagttgatattgattgatagcaaggatcaactatgcccacctcttcctaagtttctaaaggctaccataatatttgtaaacaacaaatttatctaatattttttacaacttgctaatcaaggaggattcatattaaaacagacaatcagtttctaaaatgttatccctgaaagggaatggaatagagtatttttagctgtaagaacctaccagtctgttttttccctttgaaaaaaactaatgtttgagatttgtgtcttttcatctgaagcagttactccattaatagtaaagatgcctcgggaaagtcagtgaaccagaatagtgctcttgcaccactgagggtgctagactggctttgtgcatcttatttcctaagaatatcagtttttattatgaccttaattataaatacctatatataggagtaggattttctctcacccaaccctactttaatcattatcacttaagtgtaaacctccacctccccctctttccctttaccgaaaaaaaatgcactttaattcctaaggagagtggctgttcctggccctgaaaccagattacttcaggaggagagttaaggagggagagctcttaccagaccctgtgaaatgaaccaaatttcttaatgtaaacacacaagtaataacatccacttttaagtggcccccactccatgccaaagggaaaaagaaccgccaaattgaaaaagggttctaaatacctgtcctgattttggaagtttcactggggaaaaactacctaagattattttcacagctaccaatttgtcagaaactttggtggtgttttgtgggaggctgagattttttaaattaaaaatcaagtgaaaacacaaagactctaagacacgatcctgatttgtgtcatttctaagtatcagatttgttctcccttcatttgacaggtgttctcagtctctcctcctgtaagattctgtccttcccctgatgacaagccaatagttcttggtggggttgcatgtctcctagagccccaggacccctgtcgtgtcggggaaggggggagggcaggagggtgggcagagactcgggttgggggagggagttcaaagaaagagtgaaaatatgggtttatataaacatatttaaagcagtttagcaaaagctttctcgttgaacagctttaagaacaatgtgaatgaaatcttagcaacttggttagtaatctgaaaagtctattaatgtatacttgaaattctgtttgtataaaaatgcattttcccctttattttaacactgtgtaaaagaacattatgcatgtgagtggtttgagaattaaatggtttaatactcaaaaaaaaaaat

SEQ ID NO: 50135 - DNA, 833 bp, Homo sapiens
ccatcagggataggacagaattcttacaggaggagagagctgagaacacctgtcaaatgaagggaggacaatgctgatacttagaaatgacactaatcaggatcgtgtcgtagagtaagcacacaagtaataacatccacttttaagtggcccccactccatgccaaagggaaaaagaaccgccaaattgaaaaagggttctaaatacctgtcctgattttggaagtttcactggggaaaaactacctaagattattttcacagctaccaatttgtcagaaactttggtggtgttttgtgggaggctgagattttttaaattaaaaatcaagtgaaaacacaaagactctaagacacgatcctgatttgtgtcatttctaagtatcagatttgttctcccttcatttgacaggtgttctcagtctctcctcctgtaagattctgtccttcccctgatgacaagccaatagttcttggtggggttgcatgtctcctagagccccaggacccctgtcgtgtcggggaaggggggagggcaggagggtgggcagagactcgggttgggggagggagttcaaagaaagagtgaaaatatgggtttatataaacatatttaaagcagtttagcaaaagctttctcgttgaacagctttaagaacaatgtgaatgaaatcttagcaacttggttagtaatctgaaaagtctattaatgtatacttgaaattctgtttgtataaaaatgcattttcccctttattttaacactgtgtaaaagaacattatgcatgtgagtggtttgagaattaaatggtttaatactcaaaaaaaaaaat

SEQ ID NO: 50136 - DNA, 198 bp, Homo sapiens
ctttctgtagatcaattctgcctttaatgtggctgaactattaatagttgaaacatccatttgactcttatatttttcttttaatttttagagaaaattctaagaacatttcttgaagttgcctggcctttggtgaggggattcttaacctgtacttcaaggggtctgtggtgagagaaaccaatgtccaagtttaga

SEQ ID NO: 50137 - DNA, 349 bp, Homo sapiens
tttcttttttttcattactttactggtccataatatccaagcctgggaattgtgtttattatactaatcagtttcagttggctgcctccacttccgccccagctcaactcttctcaacactattttttttttttttggagacagtcttgctctgttgcccaggctgaagtgtggtggcataatcacagctcactgcagcctcaaacttcctgggttcaagttatcttcctacctcaagcttctgagtagcaggcactacaggtgtgcaccagcatgtccaacctaatttttgtattttttgtatagacagggtttcaccatgttgcccaagctggtcttgaacgccagg

SEQ ID NO: 50138 - DNA, 152 bp, Homo sapiens
tcagattaggtgcatgcttcctacttattcccaccaggtacatactaaatcctggacagttaacataagtaccagctactctctctctctctctctctctgtgtgtgtgtgtgtgtgtgtgtgtgtgtgtgtgtgtgtggtgtccttgaccc

SEQ ID NO: 50139 - DNA, 448 bp, Homo sapiens
ctaggagagaagggagttggcaggggctctctccgtgtagaagagtgtgcatagaggggtgtgtggaggggagctgctttgggttgggggccagatatagaagggaaacaccgtaacttattaaggaaagttagtcaaaatggttttatctcccactttgcaactttttttaatttttgtttttttaggcagggtcttactttgtcacccaggctggagtgcaatggcgccatcatggctcactgcagcctccacctcctgaactcaaacaatcctcccacctcagcctcccaagtagctgggactacaggtgcacaccaccacacctggctaatttctaaattttacatagcaacttttaagaactattagatacttcttgttgagttttgctgtagattcaaagaaaattgataattatctataaaggttagtagcgactccttcc

SEQ ID NO: 50140 - DNA, 260 bp, Homo sapiens
caaccatatcccttcttccctaagggacaaagttcgtaggggaagcacaagtgctagagaggaaaagccatgggtattttagatatatttagtgcttttatcaaataagtagggcatggtttttctcccaatatttcctgagttaaattatagatgttttgagccacatagagcgatgttagtggtagagctaaatcaggctttggcttctaatccagccctccaactaggcaacaggatctgcctagatcctaattaag

SEQ ID NO: 50141 - DNA, 9390 bp, Homo sapiens
ggcaatttcttttcctttctaactgtggcccgcgttgtgctgttgctgggcaggcgttgggcgccggcggtcttcgagcgtgggggcccgctggctttcccttctcagaaactgcgccgggggcgctcgcttgccccggattcggacgcggcgctccccgggctcgtctgaagtgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacgtttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttaataacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctggacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagttcttctccagactgttctttggttgtcacttaagtcagaggtctggtccctcatgtttaggtgaaagccagagaatgacagctgtagtcatatctgagcataagaccttgatgtgtgattcctgatgaccggtttcatttattcatgtaataaagcaaaggccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttggctgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaacggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaaggcaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggataatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcaaaaaaaaaaa

SEQ ID NO: 50142 - DNA, 787 bp, Homo sapiens
agaggaccaagcctccctgtgtagcacaaagaaagtttctctgaatatatttaaagaaccatcaagaaatggggacctggattttgtttgcctgccttgtgggagcagcttttgccatgcctctaccacctcatcctgggcaccctggttatatcaacttcagctatgaggtgctcacccctttgaagtggtaccagagcatgataagaccaccatactcttcctatggttacgagcccatgggtggatggctgcaccaccaaatcatccccgtggtgtcccaacagcaccccctgactcacaccctgcagtctcatcaccacatcccagtggtgccagctcagcagcccagggtccgccagcaagcactgatgcctgttcctggccagcaatccatgactccaacccaacaccatcagccaaacctccctctgcctgcccagcagcccttccagccccagcctgttcagccacagcctcaccagcccatgcagccccagccacctgtgcaacccatgcagcccctgctgccacagccacctctgcctccaatgttccccctgcggcccctgccccccatacttcctgatctgcatctggaagcttggccagcaacagacaagaccaagcaggaggaagtggattaaaagaccagaatatgagacaggaactgaagtaaacactttagttgctttcagggatgacacaagcacacaatgatttttgcttacaatcacttaacttagcaaattctgtaactaaaaatgtaccaatagtagacaataaa

SEQ ID NO: 50143 - DNA, 287 bp, Homo sapiens
tacattctcactttttcagtctttccttatgcagtttctggcgtttccttcatttccccagattctttcaaatcctgattctcttctctgaggagtctgtgccgtccccttcagggcagtgtggtcggcgggttcaacactcatgcttccctgtcctttggcctccaagttgttaaaacagtcaatcacttctagctcagggtagctcattcttagccccatagggtccaccacagcatgtgtccccttgggctgacattgggctatggataaagcttctttttaaa

SEQ ID NO: 50144 - DNA, 2667 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50145 - DNA, 2009 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagtttgctacataaattgatatgtagctagattcatgcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagaggtatttgttttaaaagtttacaaagtatcatccagaatggctgggtgtggtggcacacgcctgtagtcccagctacttgggaggctgatgtgggaggatcacttgaacccaggagtttaagtccagtctgagcaaggcagtgagaccctgtctctaaacaataaaaattaaaataag

SEQ ID NO: 50146 - DNA, 753 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaagggaatataaagaagatgaaagtccagtccagaagaagaaa

SEQ ID NO: 50147 - DNA, 2726 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaagagtctggaggagaaagagaacactctgattgtagccccaagaagggctttgccatggtggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50148 - DNA, 2756 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgaggcaactcaaattttttaattgccaatttctgtttcttttgattctacaaaagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagtttgctacataaattgatatgtagctagattcatgcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaagagtctggaggagaaagagaacactctgattgtagccccaagaagggctttgccatggtggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50149 - DNA, 2652 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaagagtctggaggagaaagagaacactctgattgtagccccaagaagggctttgccatggtggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50150 - DNA, 1328 bp, Homo sapiens
cgtgttgcacaggctggtcttaaactcctgacctcagatgatcttcgcgtctcggcctcccaaagtgctgggattataggcatgagccactgcacccagctggcagatacctttcatcttagagtgatccactactaagaaatcttcccaagaaaattaaagagggacaagactgttctatgagaagaaattcctaagtcctcacgtggagacctagggaggagacgcctctacctgggatttcatcatgtagatgcacccgtgtagtgatacagatctaatgagacactaacatatcacacatgtgggcagttggatctgttaataaggacatgctgctaatgaagttaatactagaatcagagggtacttgtgggtatgtggtaacttatataaacagagcccctgtgaagcatctgtatccgaatcagtgataatctatcatcactatcggagaaaaacttcatgtgcacaaaagcaccagtattattgcctttatgtttggggtttgcctttgcatataggttcttgtttcatgtgagtttaccactagaaaaagttactctcttttattattactgtttttgtattacagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50151 - DNA, 320 bp, Homo sapiens
acgagctaatgacttggaacaaattatggaaagtgtgaaatccaaaattggtgaattggaggatgaatcactaaatagggcttgccaccaacagaataaaataaaagatcttcaaaaggagcagaaaactttgcaggtactgagttatgaattcttagatgatggttagttagtactaaaacagctcattatggtcccaggtgacttccatgttgtttgattcagtggtttttaccttttttggcttatcactgctaccttgaaattctcttcacttggtttctagaatgtcctttatttccctctgacctcactgatca

SEQ ID NO: 50152 - DNA, 2601 bp, Homo sapiens
aagcggaggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50153 - DNA, 2778 bp, Homo sapiens
ggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgaggcaactcaaattttttaattgccaatttctgtttcttttgattctacaaaagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaaatagggcttgccaccaacagaataaaataaaagatcttcaaaaggagcagaaaactttgcaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaagagtctggaggagaaagagaacactctgattgtagccccaagaagggctttgccatggtggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgttcctcacttccaaaagttatttggtgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtgtaatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 50154 - DNA, 2908 bp, Homo sapiens
  misc_feature (577)..(577): n is a, c, g, or t
  misc_feature (936)..(936): n is a, c, g, or t
gaacattttaaacagtgaaatagatttgtgcatttagaagcattgctttggttataccataggggatggattggtgaagatgagaagagagtttgggagtaacagaaaaccctcaaggtctcagatgggtggcctgactatagtgttggcactgagattgaaaagcagaaaaagttattaggactaatcttttggcatattttaccttatagaatagaggttggcaagttttttgtaaagagccataatattttttaaaagcctaaatactagggctttgagggccattctgcttgtattgcagctattcacctgtgtcttgagcgcaaaagcagccatagactgtaggcaaacaaatgagtgtggttgtattctaataaagctttatttatgaaatcagttgggggtctagattttgctcacaggcccttctaggctagcgtatccagtggtgaagattaatagctcaagcaatggctagagtaagatgataatataggtgagggattgtagggataagaaggaaagaggagcaggggaggaaagaaccctgaggaaccaaatcatattaggagangaggtgaaaatggtactgagggagtctgtaggaagcttagcaggaaaatggtgtataagaacttagggaggagagtttcctgaaggaggggcagtaattgcagtatcaaatgctacagagaggagaggcatgatgagaccttacaataagccattcattgtatttgctctttgggggccagtgagaagggaaaactgagggtggtggaggctggaagctagatcatgatgagctaaggagtgagttggagttgagctatttagactagttagagctttgatttaaatatttggtagtcatgggaaggaggaatcacaggttagcttgaggaagacgtagggtggaaagaaggctgttcntttgttttttatttgttaagaagggtggtgttgactaggctaaactgaagaagccagagcaaaagagacctgaggacttggttagaaaaggaacaaacgactgagcctagatagagtaagtagggagttgttggggaagggaataagaaatataagagatgtgtgagatgtggagagatcttgaagcagcctcaggtggaaaggacttgaagtacaggcagaaatgaggatgggctgcattaggggtagggaaactggaacaaattatacttagtggcctctattttctttgacaacgttaactatagagaatgaagggtctaagaggtaatacttgaaggaaaggtgtttcagggtaagcaaaataggatttatataggaatgaaggcccagctgaggtaagtactgtactagattgttattttggtaacagtaatgaacaattttcagttaattatataagatttagctatgaatgcattctggattttagttagaattgttaaaccaaattcaaagtgtggaagtcattcagttgaattgttaaaaaaaaaaaatggaactagcaggaacgttggaatttaatgagtccaactcctttttcacagatgtgaaaatttaaggcgtagaaaaataatgaatgttgtccactcatctagttggtaaccaggttttctgatttcagaaaatcaaaaatcacttgtttttaattatgtgttttatcataacacacttaacaaaaattctggctgggcacagtggctcacacctgtaatcccagcactttggaagacagaggagggaggattgcttgagactaggagttcaagaccagcctaggcaatacagtgagacctcatctctacacaaaatttaaaaagtaggcaagcatggtggttcacaaccgtagtcccagcttgggaggctgaggtgggaggatctctttagtccatgaggtggaggccacagtgagctgagattgtactgtctcagaaaaaacaacaacaaaaaaacaaaagctctcttttataaaactttcaaacatatgtaaaagtagagagaataatatattgaactcccatgtggcattttaaaacaattataatttatggtcgtttgtgtaatttatatcttgttaaaagaaagtccttagtcaaattaaagagttcaactgagcaaagaatgattcgtgaatagggcagcctcctgagccacagtatgttcagagagactccagcacagccaggtggtggaagaagatgtatagacagaggtacagaaacagtcagattggttacagctcggcatttgccttatttgaacatggtttgaacagttggccccttttaactggccaaaacttggtgattggcacaaaagtaggttacagtctgtttacacctccatttagatacatttatagttcactatgtacagagaaacctttagactgaacttcaaatatgtaaggagactgctttagactaaacttgatttaacaatctctacccacttctactcttccctgcattattttgaagcgtcatctatcagtattatgtttcatctgccaaaattttaacatgtatgcctaaaaggtaagacatatggtagtttcagtgttttttctccttttaaaacataaaccacaatatgggttaatgtggattatgtgggctaagcaggttgatgtgggttaatgtgggttatgtgggctaagcaggttgatgtggttaatttttaacttccaaagatgtttataagttattatgagtagactttttggaataaaggtttcctcatattgcagtattttggaaagtgattttactaaaaaataatacgggccaggcatgtggctcatgcccgtaatctcagcactttgagaggcctaggtgggaggactgcttgaagccaggagttctagaccagcctgggcaacaaagtgagaccctacctctacaaaaaatac

SEQ ID NO: 50155 - DNA, 256 bp, Homo sapiens
cgctggggaacattttaaacagtgaaatagatttgtgcatttagaagcattgctttggttataccataggggatggattggtgaagatgagaagagagtttgggagtaacagaaaaccctcaaggtctcagatggggagtttgggagtaacagaaaaccctcaaggtctcagatgggtggcctgactatagtgttggcactgagattgaaaagcagaaaaagttattaggactaatcttttggcatattttacctt

SEQ ID NO: 50156 - DNA, 561 bp, Homo sapiens
aaattcaaaaattacttgcaaacatccaaaaaccaagtagaatttttaaaatctttattgattcttaagataaattatttttataaattttaggtattttctaaatgctttttagttgctttaagttgcttacaatcagttttttaatcgcttttttctttttaatggtatgggagcagtttcagccataagtcaaccatttttaggctgctttgcttatttagttttgatttagaaattgaaactcctgtgttcttgaacaaagtgttacactttttaagagacagggtcctgctctgtcacccagcttgtagtgtagttgagcaatcatgactcggcgcagccacaactttctgggcacaagcaatcctcctgcctcagcctcctgagtagctgggactacagatgcgcagccccctgccacacacacacacgtggctaattttttaaaaaatttttcttatagagatggggtcttgctgtgttgcccaggctggattcaaactcctggcctccagcagtactcccacctcagcctcccaaagtgatgggattacagac

SEQ ID NO: 50157 - DNA, 242 bp, Homo sapiens
ctgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttgg

SEQ ID NO: 50158 - DNA, 864 bp, Homo sapiens
cccaaagtgctgggattacaggcgtgagccaccacgcctggccccagttttttttttaaacataattctgactctggaaataagtaggcacctttaaactctgtgtagacttgattttgttttttcttgaagtttgtgtgtatctcttaatatgtgtgctaacttaatttagggtctaggttcatgctgatgttggaagcatgccattctccaagctttttaaaaatatggatattcttaagtatctcacactgaggcacccagctataaagtaaccgtagtgtaggtaggtgcacactgcataaacacttcttctgtaagctggagaaatagctggaggagaaatctgttcttagaacaaggcacatgctgttggttccagacattctttttagtggaggatacaaaagtgtgtttaacggttgctggccccacgcctgctgtccagccctatggaatgtgctctgtctgggccacactgccagtcatcaaggcagttactgtgaggaaggaagaagccagctcttcagttccttgacctgagcttttctggccaaaagaaggaatctgttttgaagattaggtttcccacctggatcctgcccaccccacccacccccttctgtgaactgtccggcttatcgaagaagacccatttttccttcttacagttgctgtttcttcattgcaagtgattcaccctgaacgtaaagttaggaaacttagtttataaggaactttatttggtggagaaatgtcaccccattctctcgttaaaagatacgatgtctggattgattccaatatctgtggtttttggcacatgccatctttctgaaattgcttctctgtgttttatgtaag

SEQ ID NO: 50159 - DNA, 271 bp, Homo sapiens
gatgcatttctatatatggcaataattaagttaatagagcataaataagttgataaaaggaagtctgattatagcattattcctcaatacttccttagtttcgttttataaataatttaaaaattaccttcccaatgtttggggatgtcaggtatcagaccatacttgtaaacatacttgtaaaatgtcaggtatcagaccatacttgtaaacagttggttgtagcctggattatgaataatttgtttgcattttaatcagtttataagcc

SEQ ID NO: 50160 - DNA, 251 bp, Homo sapiens
cgcggccgctgtaggtctagctttttcctccatattgatgaactaaaactcactcatttcacaactcaaagccagggccttcagttcacagcccgttgcctcagacggccttccctgaccatctaacatagcatcccctgttactctccctcacttctgtgttttccttcattgcatttacctctccttaataggatactgtagctttccttatgatctttctcccccattcgaatgtaagccctaggagg

SEQ ID NO: 50161 - DNA, 642 bp, Homo sapiens
  misc_feature (1)..(1): n is a, c, g, or t
  misc_feature (29)..(29): n is a, c, g, or t
  misc_feature (52)..(52): n is a, c, g, or t
  misc_feature (55)..(56): n is a, c, g, or t
  misc_feature (73)..(74): n is a, c, g, or t
  misc_feature (138)..(138): n is a, c, g, or t
  misc_feature (142)..(142): n is a, c, g, or t
  misc_feature (180)..(180): n is a, c, g, or t
  misc_feature (226)..(226): n is a, c, g, or t
ngagctaagaatacaaacccacactttgngccagcctgaaggaagagtacgntanntcatcactcggaagttnnaatgatctaaccaggaacacactacatcaatcctttaaaagctataggattcatttgatgcttntaancacttgatttttgcattctgctaaaaaaaaaaaaactnatcttgctggctactaaaatgttgaactcactgaagagtgtttcangaagtgaaagctcattaaacctaacagtcaaaatgcaaacctaatagagtacttctcctgccaatactggtattagagccagatgctggtatttagacaataaaaatttaaatctttagttaatgacattaaattgaaataactcaaaactctgaaaggaaaaaaacctttcaaatctgataataaaagtacgtaatttcttaaattgtgacttctttttgtccaacagattcaggcaaattctcaaactgggggaagaagcaacaaacaaatattatcattgatttctattattttttcttttagaaacagggtcttgctctgtcacccaaactgaagtgcaatttctattttaagtttgtgttgggtaaaaaaattaaatgcactgtttggtcctttcacaactgtcagaagcc

SEQ ID NO: 50162 - DNA, 789 bp, Homo sapiens
cctgacctcaggtgatctgcccgcctcggcctcccaaagagctgggattacaggtgtaagccactattcctggccaattttttttcattggtatcatacatgagatattttttcttctattatatcttcttactgattattatttgtttataaaaaagcaaaagtgtttcattgcttttgttaccattcttattacttagagtttttactcaatttttagtttattttataaaaataatgttttttcctcttcctttccaatatttgtgactcttcttattcttgactagtcaaaatggctagtacttccagaacaatgctaaataatggtggtagctggcatctttgccctttagtgacgtctagtattttaacactaagtatcttcaaggtatagtcatgtgccactaaatgatggggatacattctggaaaatgcattgttagttgatgttcgttatgtgaacatcatagagtgtacttacataaacctagatggtagagcatactacacacctagctacatggtatagccttttgttcctaggcaacaaacttgttcatcatgctactgtactgaatgctgtagacaattgtaacacaatagtgagcatttgtatatctaaatttttctaaatatagaaaaggtacagtaaaaatatggcataaaaaataaaatgggccgtgtgcagtggcttatgcctgtaatcccagcctcccaaagtgctgggattacagcttcagccaccacgccaggcccatacgagtatatattttcttgtaaaagatt

SEQ ID NO: 50163 - DNA, 412 bp, Homo sapiens
ctcaggctggtcacaaacttctgggctcaagtgattctcctgtctcagcctccctaaagtgctgggattacaggcgtgagcccctgtgccctggcctgtcctctcttattgatggttatggtttaaaaatactgattccttatgttcctcatttgtagctaaaataatacatttaaaaggatactttattccaatattttataaatttccttttatagggtagattaaataattataatctggtactatttaagagcctcatatgttcactattccctgaaaaagtgaataaagtctctaagtctacttatgaagtttatggaaacacttaacttgaattatgtggctaggaacaaaattagaagtgtattgttaaaagataatttaaaaataaaattacagtacatgcaaa

SEQ ID NO: 50164 - DNA, 586 bp, Homo sapiens
tgttaattagctggaaagcaaagacagacaggatacaaatgttcctagaaagaaactagcatagtgtgacgtcagtactgttttcaacttttagctgctaccctttcctgtttcctgaggacatttcaacatgacttcgagcacagttaaagtgaactgccaaggttaagcgagctttccttccttacggaatctcccagcccctaattctataatactactcgcttagtttggctgtggtgaaacccaccttgtcctctactaaagatatggaacgaagacctcgtcagtcaatcttccatgatcccggccaccgcaattggctcaggtcgttgctgccatgaagtaagagtctgtctggaaatgaaggcgagcagaggccacaaagctgagacatggagacagagagagtcctgatgttattatttgaaccattgagtccagctgtgcctgaaactcttcagtgagccaagaaattcctttttggcttaagccaattggagtcgtgtttgtgatacttgcaaatgaaaggagttattgactaataaaactgccatttctatctctccaagaattaggaaatact

SEQ ID NO: 50165 - DNA, 445 bp, Homo sapiens
tgttaattagctggaaagcaaagacagacaggatacaaatgttcctagaaagaaactagcatagtgtgacgtcagtactgttttcaacttttagctgctaccctttcctgtttcctgaggacatttcaacatgacttcgagcacagttaaagtgaactgccaaggttaagcgaggtatgggcctcagagccacaatgcactgatttttctcttggtttctcaaagggaaggtatgtgaaaccacaatgggaaatacagatttccaagttttatttttatttgcatgcaacatatatttgcatgatcctttattcttgacatttttgcattcataatttcatttgaagttttaccagaatcattttaggtaaggtgggcatttatctttccctatctcatcagaatgagatatttgagcttagagagctactacaggtagtagtga

SEQ ID NO: 50166 - DNA, 796 bp, Homo sapiens
tgttaattagctggaaagcaaagacagacaggatacaaatgttcctagaaagaaactagcatagtgtgacgtcagtactgttttcaacttttagctgctaccctttcctgtttcctgaggacatttcaacatgacttcgagcacagttaaagtgaactgccaaggttaagcgagctttccttccttacggaatctcccagcccctaattctataatactactcgcttagtttggctgtggtgaaacccaccttgtcctctactaaagatatggaacgaagacctcgtcagtcaatcttccatgatcccggccaccgcaattggctcaggtcgttgctgccatgaagtaagagtctgtctggaaatgaaggcgagcagaggccacaaagctgagacatggagacagagagagtcctgatgttattatttgaaccattgagtccagctgtgcctgaaactcttcagcacacagaagacaagctttcccagccctttttggttagatggggcttggtgactccataccaatgggatgtgagcaaaagtgacaccgatcactcctactgaagcactgaagcgcaggagagaggtccaggctgccgaggagaccgaaggagtcctgtgttgtagatgtcctagctgttgccggtactgatggtagagcctccatcagcctggatccttgagttactgatggagcagaattccctcaacacatacatgcccaacttggacttgcaatggacatatagcatatgcaagaaataaactttttttgttttcggctttgggatcca

SEQ ID NO: 50167 - DNA, 702 bp, Homo sapiens
aatcagagggtgcattcaaatcttgctctgttgccccggctggagtgcagtggcacaatctcagctcactgcaacctccacctcctgagttcaagtgattctgctgcctcagtcacctgagtagctgggattacaggcacatgccaccacacctggctaatttttgtatttttagtagagaaggggtttcaccattttggtcaggctggtctagaactcccgacctcatgatcctccccgctcagcctcccaaagtgctgggattacaggcgtgagccaccgcacccagccctcaatgtcttttgcccttgaacgttcatctgatctggagttttaagtggttttgccaaaaagcgtgtcttttgacatattctcgatggtctgccatattcagggaaacgttaaaatataccacacttgaaagagtagtccggcgacactctcaataataaccaaacgctccccaccatgtctgccatccttcctccctggggcagagggcctgacaagtgacaaccccgctctctcttcctcaggccctggaccctcagggccccctcagttctggctgtggacagcagggacatgttgggttggtaggggtggagggaattgataaaatgtaccatattgacttatgagtggataatggttgtaaaaaaacctaaataattccaaataaaagctaactgttactgagca

SEQ ID NO: 50168 - DNA, 419 bp, Homo sapiens
aaataaaaagtagggaagagcttctccatgggatcagatcacagctttggggagtgggatggggcctctatgctttgatctatgcatgagctggggtgagaagttcccacctgcacctgactgcaatgactgtaatggctggaattgtcacctcttctccctgataggctcttcctcacctggaggatcggggctggtgggagggcagggaaggggaggccatcagccagaatgtattttctttcagttccatttcctgaggaagaacttgcttttaaaggaggaaagggacagaatcagacctaaataaaattcctgagtatgcaatatttctctttagtgtctcttcacctccctttctgagtttctttcctacatcctggctcttcattttcccaatgcccaatataatcatggtt

SEQ ID NO: 50169 - DNA, 629 bp, Homo sapiens
ctgggtcccaaccctcggtgccaggtgtgaaaggagcagcatggctggccccaccccctcaggccagggatggtatggtttcagggctcaagggcgagcctcctgcccaggcaggattgattccaatggtgggttggcttgagcttcagggtgaaggtctggagctaatcttgttggtgaagcctgaatgactggaggaggagctgcagaaccgacccctcagctgctgtccttcaggagcctctcttgtcccaatccagggccaggtgcctttcacacagttaattttcacaacaatcttaaatggcagatacttttgttatccccctttaacagatggggaaactgagcagctgagagaggactgagggggacctacccaaggtcacatagacaataaatgcagaattgggttctggacccagacttcttgggcttcagagcctgattctctccaggacacttactgctggggagacaggcacagacgtggagagaagtgcctcatgcttggcacgataagatagaatgaggctactgtaggaataaacgtgggcacactgggtgttacaggaacctggccacagagaaactgacctaggagggcttcctggagagagcaaccatct

SEQ ID NO: 50170 - DNA, 346 bp, Homo sapiens
tccagagtctacttggtcacccaggctggagtgcagtggtgtgatctcagctcactgcaaccttcgcctcccaagttcaagcgattctcatgccctagcctcccaagtagctggaattacaggtgcacagcaccacaaccagctaatttttttttgtatttctagtagagacagggattcaccatgttggtcaggctcgtctcaaactcctgatctcaagtgactggcctgcctcagcctctcaaagtgctgggattacaggcgtgagccactgaacccagcctcttagtttgacatacggttttagcggttactttttccatgaagctttcttcaactattccag

SEQ ID NO: 50171 - DNA, 386 bp, Homo sapiens
tctccactcgatagataaaggcaggagttcggggatccccaataggtagggactgcacctcaagtcagggtgacgcagttacagaagaaagaccatcagtcactctgtctcccataaagatttctggggatcatgtctctcgggggaaatgaggcaggagaatagggtctggaggcagggaacctaagttcgatgcatgctgactggatatcagaggctactccctttcaacccctcctttttctgcatggcagttgctgcctggcagttggaaatgaaagtacctcggattggttccctcccgcaaccaatcagactggttgcgggccactactttatgtgcatagagtgaacagatgggaaacccctggagggtatttaaaccc

SEQ ID NO: 50172 - DNA, 392 bp, Homo sapiens
agttgtacccctccatagaaaagacaaacttccatttaaacccagctttccaatcttggttaaatttgatgagtgccacacagaagaaataacaccgaggaggacattttcattccaatttgaagattctaaatgataagagcaataaaggcatttagtaaccaccaatttatacatatttctcctacttgaagaaccctaaactcattaaatcatttttagtttaattgtgagttataaatgaactcacataaagttgtttaaatgatttgctcaacagaaccaaaatgtgattctacataaaattttattagaatatacttattacaaaaatatggcatacttggccaggagcagtggctcacacctgtaatcccagcacttaaggaggc

SEQ ID NO: 50173 - DNA, 313 bp, Homo sapiens
aatggagcccctataactattcttatgggggatggtgagcaaaggccttactgagacctctttgtgagaacttaaaaactatgtgaagttaaaaactatgtgtattcatctagatcaaaatcttttttctttttggttagttatggaaataaaactttatttttcagtttaagtttacaattaagtaatatcataaaatagatattttagtttcttaaatcagcatttttctattacctgggagtttattagaatttttaccttttgagtttatgtagagatgagaagaacctgaactaaggcagagtcaagg

SEQ ID NO: 50174 - DNA, 244 bp, Homo sapiens
gggaggctatccctgcattttcccactacaatctttaatagttaggggaagattttcatttagttaaattctcttctttggtattcattcatttaaaatgtgccaggacgtaagcacactgtgacctcttcctataaggcggagcttcctagaggtgctgtgtggtcttgggggcacctggaacggcctacaggggtgccctgagttcttcatgattgcatgctttttgtagtggtagagtatg

SEQ ID NO: 50175 - DNA, 558 bp, Homo sapiens
tttttgtttcccatttctgagcattctctctgaattacagccgtgaccgccgtatcgcagcgtgtttgcccagcccggtttgagttgtaagctggtgaaatagaagaatccttgtgaaaatatgaacacacttttatttaccaaaggtaaatgaaacctttcactgttctgaagggtttccatttttctgtcttttgtctcctccctttgattacccataacattaaccttcaaacaacctggcaaatccaagtctgatttcccggcagcctcctccttcagccaggcagggcacctgttgcaggccctcttgggatcaccaggcagagaagcttccctgtgcttcacacccactcacgcctgtccccccgtcctgggggaaggcagttccaggctggcccatggtcactgtgaagcgctcctacttaacaatgcaagtagccatccctctgtccagctggctttgacagaggctctgccgccgcagcttcttgcccgtggctctgtgatggggaaaaaaggaaggaaaaatgcgttccacgccgagccctatgcagt

SEQ ID NO: 50176 - DNA, 277 bp, Homo sapiens
cctgggagcctcctggattgtgtctagtccccagataggggataacacgctcctcccagcctgaaggccatcctcctaagtactcacttggcaggcatcctggaaaatggttgtgttgtaaaggctaagttactcttctcagagatctctatttgacatgataaagaaaaaaaaagctcaaagcgcaaactgtatacaatccaacgtacattttaaaagatgtactagtgagtattttatatagtgggtcagattttcattctgtgagattcaaaag

SEQ ID NO: 50177 - DNA, 293 bp, Homo sapiens
gatttcaacctaagatcaaggtgacttatacgaacaatcccttttccctgttattcgaataagataattcttcattttgagatattactctgacttattttaacattgtgagcagtttttctcagatggagccctgccatgaggcataatcttgtaggcaattcttattgcctgaacaatcaccattttttataaacaagaagatgagccaagagagaagaaagtcatacaagtgtatttcttgcactggatttctaagtagcttgccccagtgccaccataacaggaccatt

SEQ ID NO: 50178 - DNA, 338 bp, Homo sapiens
aatacttgtactaatgaagaattgtgagctatcttaaaacatctggtattaatccagatatttcagtactacataatttccaaggttatacttctttcttagtaggaatgttaaatatacaatttcttgtcctctgtctgctagtttaaggtttctttcagtttgttcagtttgataaagaatcagtaaacttaattgagaagatgaatgttcaaaagaaagatgtatattaaacccagagaatgtctgaagtgagagctacataaccaattctggtagatgttagttttatattttcagatactcagaactgaattttacattttattattaatagc

SEQ ID NO: 50179 - DNA, 505 bp, Homo sapiens
gtctgtgtgagtccactttcttttttgttccctgctaggtagcacacagctgtgaggagcccaggactgctgcctgccgcagcccacctgtgcgctcagattcctaccagcttgatgagttagctgatgggccatttgtgcataccaactacccacagacatttctattacccaccctctggatgccagtgcattaatgattctagaattaggagaaaccaaagatcccttctctctccctcccacaaccagtgtcgtcgtgttcctagaaataagagtagaaacccctctatctgggttaaaacagcaaacctgccttctgtaactgtgcatgaggttcctctgtctcccacttacttcggattaacaccttcctctttccccttccctgtttgcagggtagcatttctaggtttaaggcaatatgcaaaaagacccaaagttaggccctggctcaaacactgtgggtagcagatttgaaataaatttaaattgcatgtttgtc

SEQ ID NO: 50180 - DNA, 1321 bp, Homo sapiens
  misc_feature (149)..(149): n is a, c, g, or t
  misc_feature (256)..(256): n is a, c, g, or t
  misc_feature (324)..(324): n is a, c, g, or t
  misc_feature (430)..(430): n is a, c, g, or t
  misc_feature (449)..(449): n is a, c, g, or t
tgtacatacattgattaataaaaacaagataattcttgactcacttattccagttcaggttcactggtgaccagagcttatcccggcagctcagggcacaaggcaggagccaaccctgcacaggccgccatcccatctcagggcacacncacacatatccacactcatactgggaccatgtagacacaccagttcacctaacatgcacatctttggatgtggaagaacagaatagttggagaaacccacacagatntggggagaacgtgcaaactccacacagacagtagccctggctggcaatcctttttttcctcatcagcnttataacaaagtaacattgaacaaaacagcactatctgtggacctgctgtaactcaacctagcctgataagtgaaatccaaaaatttaatcaatgaatgtgacacntagcttgtgtgcctatggntcctgctctgccatccaagtctgtttagtccacagcaggtgtggtttggtgcacctgctgtgatgtgtagaatgcagatgggaattagaactatgaatgcatgtgtcctcagagtcaaatgaagaaaatatttcaagtggattgatcatgtgtcaaatgctgctgctgattcaagtaagatgagaattagatttatcagtatgagtttggagcctcacagcatgatttaaaagagaatgaaaaacgaggaattgagatatgaatatcgaaaactcaagagttttccttaaagagaaacagagaaatggggctataggtagaaaggaatataggatttgagtttttgtttttttttaatgggaggatgtttatacattaatgggaatgcagtcaggagggaaaaaagactgaagagggagagttgctgaaacaacacttgataggccgtaagaagggatctgatgaacaaatggagaggctggctttaagtaggaatagaaacagtccaattccagtactaggaaggcagagtaatgggcaatgggggcaaagtagtggtggtggtggatggaaacaagtggaagttttctaattgctcccattttcccagcaaaataggaaacggggtcacataggacaatctctagtgcttgtaaatctaaggaaataaaaagacaaagatggtgataacataataatttgtgctgttgctcttcctaaaatgtgctctaatttttcagaatccgacctatccactaaagtccagctccagtctagcctgcttcaaagcatgatctctttttttcagttaaattcagattgtgtgaactattcatctggctcttggcatgttgattatctttaaaaaaaaa

SEQ ID NO: 50181 - DNA, 238 bp, Homo sapiens
taggtgagattacaggccagtgtcaccatgcccgtcatttttattttttatagagaggaggtcttgttatgttgcccaggctgttcttgaactcctgggcccaagcggtcctttcaccttggcatcccaagtgctgggatgacagatgtgagccaccacgcctgggggatttcgttttgttttgttttttgccctcattggatttaattcccgccgccaccctcttccccacacacac

SEQ ID NO: 50182 - DNA, 342 bp, Homo sapiens
gtaaaatgtacgtaacaaaacttaataatttttcagtgtacagttcagtggcattaagtacattcacattgttaaccatcaccactatctatctgcagaactttttcatcatcccaaactgaatgtgtactcataaaattttatgagtggcagctcttcaatttttcttttcttttcttctgcttcagataaccaccattctactttgtctgtctagaaacttgactattgcaggtacctcatatgagtggaatcatgtagtatttgtccttttttgtctgggttatttcagtaagcataaaatcttcaagattcatttatgaagcatgtgatagaattccc

SEQ ID NO: 50183 - DNA, 383 bp, Homo sapiens
tttcttttattctttcccagatcatgtgtagtatatgtgtagtatgtttgtcagatctgtgttctgttgggtgacttgaaatggaattccagggcttaaccttgagaatattatcagggaaaagaaatgggggtggggagaaccaactctcctattatggcttcagaaaaatgaatatagtttcccaagaaagttagtagataaattggggaattacaaagattcaccaaaacatcaatttctcttgcaaggtggagaatttgtgacggtgaataactgttctgtttcctgttattggaacttagcagattctaaatcttagggaacaggacctggcaacaactaggaatcctctaataggatttttgtttactaaatgattt

SEQ ID NO: 50184 - DNA, 439 bp, Homo sapiens
ttgagaattttatgcaattctgttttctctccattcttagcatatcaattatataacttttttttgactattttaatggttgccctatggaataaaactttcatttttcatattcttaatttagtctcacagataatggtttctggaaaataatagtagcaccaatctatttgattaggcatgcttatgtctatatgttatatgtatataaatatacatgtatatgtgcatgtgtactcatgtataagtgaaaggaatgacagcactaatagggagaacaaaagagttaagattattttgttattctaagatattcacactacctgtgagtgatacagtgttttttcaaaaaacactttttgagaagtatcttggattcattttaaatgtaatattgcaaactctgggtaagggttttggaccaagggcctcagttctt

SEQ ID NO: 50185 - DNA, 249 bp, Homo sapiens
cttgctcggtgtcatgcacgtggcttctaatattatgtttaaaatgctagtgaaattataatcctgttgtagtgcctttggaggctcgttcatcaacctgggcagtacgtgtgtctggcaaggagccagcgtcatcccctgcccccacctccatatgactcagcacacatcagacactttaatagcttctgattccaagtttgaacttgccccccaaatgaaaacctccctccccctctcccttctcct

SEQ ID NO: 50186 - DNA, 451 bp, Homo sapiens
ggaacccagcctcctccccctgccacacattgcccacattgaagaaccaaatcttctcctttacccacattgataaaaccaaatcctgggacagaagtgcttcaaggccgaaacagagagcccatctcttgtccacacagcatgggtagtcctggctgggtgcagaaagcacagtctaggggttttgagaaaagggagctctacctggaagagacatcctaaagaccctctcaccacactctggtttttcttcagatcgtgtaaatctttcaccttttactaaagaacccctgtgtccatcctcccaattccccctgccttctgctaccagcaaaaatttcactccaaactaaacctcaggaaaagctctctcatcctcctgcaggccagagaagcacctttccccacacagatttaggtatgcttatcaagatagctcctagacaagtac

SEQ ID NO: 50187 - DNA, 650 bp, Homo sapiens
aaggaggaaaaaataaaaaagtacagctggccctcatgagttctagctcctggaatcagaaactagaaaggggacaggacgcaaaacagttaccgtttcaaactgtgaagcagcaaggcctctggcttctgcatctgtctttcactctatgcatgctccccctgctccattactactttggcatatcctaaatatggccactccagccccagctttaagtggcttccttaagtcaaattgtgcccaacagaaagtgtctctctgtgtaactatattcctagacaatagagcaagccttcaaaattctgtgggaaaaaaaaaatttacctagaattatatattcagccaaactataaaccaaatgtaaggaaagaaaaaagacactatcatgagatgcaatgactcaaaaaaatttgccttccatgtgatcttttcaaagaagctaccagaggatgtgcttcagtaaaacaagaaagtgaatccataaaggggataaaatgacatacaggaaacaaggagtctaacaaggaagttctaggctggacacagtggctcatgccagcacttttggaggccaaggtgggaggatcacttgagcccaggagttagagataagcctgggcaacacagggagacaccatctctagtgg

SEQ ID NO: 50188 - DNA, 807 bp, Homo sapiens
gccataggcatatggtttgctttcatattcccagaaaaggacttaagagtcagaaaaggatgtgcatttcccataacccttatctctccctctttattaacagtatgataaagtactacaaatttttaagttctcaaggaatttaagaacatattctacataaattctaaaaacttaacaaattcagaatacaaccattattttgtgaactgttcattacagaatcccaaccccttaacctatctactatcagctccacctaaaacaattaaccaaaatgtacaattagaactgaaaatatttactagcaatctataaattcaataagataaccaaatttaatagaattagaaatttaaaataagggattctcctaaattaaaaaaaaaaaaaaccaaccatctcagtagtcagaattttcataagactctctatttttattcatacttcagttttaacaattaatttatgaaaatccttataggtcacaaatattttcacaaacattaggtcacctaacctccctcaaaagaaagtattaccaggccccttttatgagagactgagatatttaatttttacatgtcacacttacctaacagcatgaattaagaggtataggagggtctaaaacagcattcttcccacttcacattttgagcacttactgtaagaggtaatctacaaggtatgtattttgatttgatgtttcagaaatattgaagagtgacattcccatttattccacctatgaaatccatcccaagattaatccatgaatgttcccaagacaggagttagggaaac

SEQ ID NO: 50189 - DNA, 317 bp, Homo sapiens
caaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaaaca

SEQ ID NO: 50190 - DNA, 428 bp, Homo sapiens
ggattccagtataggtttttagtccattactaaacttaaagactctttgaagtttgaatcttcgtcagagatttctttttatttttaaaaccttcagaacagtgtctggcacatggtacataattagtggagagaagtgcattagaaagctccaatccagaaatctgtaggatgatggggaagctggacagccctttgttgtagtctagtctttcatcaagcgtctatcaggacccacttgttgagttgtgaaagaaattgagtgagccaatgctgggaatttttaaataatagaatagaaaatatctgccaggcatgatgatggctcacgactgtaatcccagcactttgggaagccgaagtgggagaatcctttgagctcaggagtttgagaccagcctgggtagcatagggagaccccctctctt

SEQ ID NO: 50191 - DNA, 481 bp, Homo sapiens
acagttttgttttcatactactggaaatttatccgttacatatgcttgctttttaccgtttccacacttttcttcctcatgctcttttctcagatacctttacatcttattctgtggaaacattgtttctgattacatttttatgttcagaagtagacttttctgttcatattctgagagtcatctcatttattcataagttcttaattttgaaaggttagaaaataaaatatttaatatcgtaacatacttgctatgttgctgtaagtcacatagaagaaaacttattgtctttttttttcacattgtcatggatcaaggttgttagataaaatataacagaaaaaggataaaaaatgaaaaagactgcttacgccgtagtttgtcctatcttgtttatcacatgaatttcgtttagtgaaatggatctgttctaaaatgatatatttagaaccgtatctccttccctattgggtcaaaa

SEQ ID NO: 50192 - DNA, 393 bp, Homo sapiens
gtgactgaattcccacaaaatatgaagcattaatgcaacctgctttcctcatgtccatagttaatgtgtgaagaaggaatgtgcactcttttaaacccatttcatgccatcctggatttgggaaggatggccagtcatgtggggactttgtggcctcttcccttgtgcacctcgggttcaagccccagttctgcgcaattgcagccagagagtggaaagagccagcctgatgatgatggtgatgctaacgtgcttgctctgcggcaggcattgtgctcagtggttctgcgtgttattttaatcgaatcctcacaacaggcctgagccgtcggtatgttaataaccctgttttgtagattaaaaaattaaaacctggtaataatgaaagctccc

SEQ ID NO: 50193 - DNA, 2633 bp, Homo sapiens
tataggttttgagtagaaactattaccctcacacctggaaagagtaagttagatctactcttacttcactttcttatcctcattgtcgtcattatcactgaagatgcataacgctgtttaaagtctgaaggatgatacagaactgacggtaaacctctctgaaccatgtttaactgcctaaggctagacacgcagtgatatcagaattaatattgttttctttcaaatgaaggattctgagctgtggaccagagtgaggatgtgtatttatgggcttctaggtggtaactgttcttgtgtctaaaccttaattaacataacactctttcacacgaataaaactttcattcattatggttttggcccataaaagttgaagttttttgtttttgtttttatttttttcaccaaatcagccctacagcgattcctccacccccattagcaaataccgtaatatatgtctctagtaatcatcctctcacaattctgcttttcctaattttgccgtgagtcaagtttcttgaccacaatgttatgctgaggaagatctaatgttttccatggagcagaaattgttagtcctcaactccaaggtctgccttgtcaagccctgttttccgtgtcttcataaaccttgtcaggcatttatttattcagcacatatctactgttctctgcacaagaattcataaggatctgatgaattatgtcccttctgagtggaatttattcccttctacatttctgcaaaacaggaaattggtagtaagtcaatttgaaggtactatttagctggcacttctgccctttcttttttaacagctgcctctatagacagaacgttgaaatgaaaagatagggaaaattggcagaaacactctgcatgtaattcctatttagacagttttaaacctattttacaaatgataaacctggaatatagtagggagagatttggtgatgaaagaatctagatttcttaactccttattaatacgtactttaagtattggactacaaacttgcatatgtcactggtaatcattgaacacatgttatcatgtaggcactatcaaattggagcctataattgatgaatgagggatatcactactcatctacagtaaagggtcctgaaatgcagaaatatggaactggtgtgactgtatctttggatatttcaagagaagccagaatacatgaattggattcgtgtgtgtgtgtgtgtgtgtgtgtgtgtgtgtgtgtgtgtgtgtgtattgggcatgtatttgacttttaaactttttttttttgagagagtttcattctgtcactcaagctggagtgccgtggtgcaatcttggctcactgtatcctccacatcttgagttcaagtgattctctcacctcagccactagagtagctggaatacaggcacacatcaccatgcccagttaatttttgcgttttttttttttttgtagagacagagttttaccatgttgaccaggctggtctcaaactcctgggctcaagcaatctgctcacctcagcatcccaaaatgctgggattacaggcatgaggcactgcacctggccaaaatattaacaactatttttaaaggcagtactagccaaagaaaacgtgacctgatagagattgtgacttcagaagtttaaggttttacctcctaaaccacatgcttcatttcatattgcattttaactgatgcccttttgttttattctgtagcctcttccccttactctttcttcctcagtgtcttcatctgtgaaataggaataagaacatttattttttgccttcaaacgaccaaggattgtggtgcatgtgaagattaatgaggtcatctggttaagctcttctccctgggtggaagaacaatggcttgtgaatactaagtggcatttgaatcatgtgtgctttcatggaaagagagctggtccatttagctccccgtctgcagggagttataaaagaagaaactagggaggaagaagctgaaaatatttcttcatgactatttcctctggtgaagcataaagtagcaatgagaattctgagatttgtttgcgtgatactttagtcatgcaccacataaagatgtttcggttaaggacaagttacatatgtgacggtggtctcataagattataatagaaattaaaaattcctattcctaagtgacatcatagttgccataacatcacagcacaatgtgttactcacatgtgcgtgatgatgctggtataaacaaatctattgtgctgccagtcatatgaaagtatagcacatacaattgtgtatggtacataatgctaatcatgataataaagattatgttattggttgacatacttactatcctatatttgttattttagaatgtaccacttctacttataaaaataagttaactataaaacaacctcaggcaggtccttcatgagatattccagatgaaggcattattacagagatgatagctccatgtatgttattgcccctaaagacttctcgtggagcaggatgtgaatgtggaggacagtgatactgaacctgaccctgtatatgcgtggattaatgtgtgtgtttgtgtctttttaacaaaacagcttaaaaagc

SEQ ID NO: 50194 - DNA, 333 bp, Homo sapiens
agtcaggaatgacccctccccatcagtagtatgttgaccaccactatcatccctaacctcagtcactcatccttcatgtttctgatgggcagttaccatactctgattagtggtatagatcattgtaccttctttagcctggttgtttcctgaagatggaaccgaggccgggcgcggtggctcatgcctgtaatcccagcactttgggaagccaaggcgggtggatcacctgaggtcaggagttcgaggccagcctggccaacatggtgaaaccccgtctctactaaaaataaaaaaaattagccaggtgtggtgatgcacgcctataatctc

SEQ ID NO: 50195 - DNA, 444 bp, Homo sapiens
gggtgaccaaaaaactttactgacaacttctcaagatggctttgtaagaagaccctcttgacctcctccctggagtatccatttatgagaacaccaggcatcccagatgcctcgtaatgagagtggtccggaagggatactagatgcccgtgatgatccctggagcaagttattactaacttgaaactaagtaatctactcctgcacttttaacaagcctcagagtgcttcattcattaagagttcagtggcatcggttaattagtggtttcctgaaagcctactgaacaaaaaactaataataattacaccaggcatctccccaggagttcaaagtgccctcagaagagtttctcatttactcacttgcattggctttaattttttttttcttgaaacaatgtgtaaataaatattcaaagcattaaaatttcattatagttc

SEQ ID NO: 50196 - DNA, 255 bp, Homo sapiens
ttaaaatctagtttaggagcatctaacttcacatgctgaaattttcttttgaaatttcctttgaaacccccacactgcttgctctgtagctcatggaaatcacttacttcataccatgcttcattgcaaacctgctttggtttgcttataagtccctccatgaattcagtggaaatgtctctcccagagaatgtttttctcttaaggtctggtccatggtactttatttgatgtccttattagaagacatctaga

SEQ ID NO: 50197 - DNA, 1017 bp, Homo sapiens
ctcatcctcgagccccactactcagaggagctgggaagaatttccacccttcctagtggcaagtctcactgtgagagcggagtgccaccaggcaaacagggcagaaagactgctttaaggagaatccttatattgggggttatgaagtgcaatacaccctcatcctcacgctaacactggtaccatgtagcccaagcttgtctaacctgcagcccgcgggctgtgtatggcccaggacagctctgaatgtggcccaacgcaaatttgtaaactttctaaaacattatgagatttttttttctcatcagctatcatcagtgtgagtgtatgttatttgtgactcaagacaatccttcttttccaatgtggcccagagaagccaaaagactggacacccctgatgtggccctttcatccatagtagcctattttgtcctaaagacggtcttgtgcagtgagtaggccaggcctccccactaccacagtttacaggcaaggaatgtgatatttcataggatgaccctgactggcacctacattgctagccaaagaatggcacaaagatgtggacagaagagacaaccttaagcagctgactgctggctcctgcaacagtatcatcatggcatttgtcctggggtcccaaggaaagaaaacaaatctgtggctgaggaacagactgagttgacaaagcagcttccacagtaacacaaggacaaagggtgtatgtagatatgcacgtggtagcaggttctactaaaggaacctggaccgaccattctcactcacattctttgggagctgtattctaatactttcagaaaagccatgggaacacaccagagtgactgctcgagtaaataagtagcataaacagcaagccaaaccattgatgtacacatcactgggcccaatactatgaaatcccacataagaaacttgaaagtgaaagctggaattctgaggatactggttttgcttaataaacagcatttcaacaggtgagtcaacttagta

SEQ ID NO: 50198 - DNA, 271 bp, Homo sapiens
tcaagcgactcccttgctttggcctcccaaaatgctgggattataagtgtgagtcaccgtgcctagccaaattcttaaaactacttatccaggtccacaaacaactcaagcaccatattttggatttttcaaatccgattaaattcattgtttatccattggaagtacactgactttgctaatatcaaaatggctaaattttaccatattttccctgttcattccaagcacactgaattcatcaactatcagaattctcaaaatttacatg

SEQ ID NO: 50199 - DNA, 337 bp, Homo sapiens
  misc_feature (7)..(7): n is a, c, g, or t
gactctncagacagtgggcccatcccatgcccgagcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaa

SEQ ID NO: 50200 - DNA, 697 bp, Homo sapiens
agtactaggattacaagcatgagccatcatgcctggcctggctttcttgattataagtgtgtttgtatagaaaatcacaaaacaggcatttgtaggtatatgctagacttagttctgcttccttctccccttccccatctctcctctgatggaaaggcagatcagagctagagggaaaatgaggggtagcgttcaatctcagaattactctgtcaccaaggttcctcttccaatcttttaagagccagtaatcaagtaaagatatactgtgtatatataaccatataaagatatacacaatgtttagagatacgctgcatatccagctttgctggcaccaaagtgaagaagagatgaacagaggaaggtctattccctaaggccacccatccacctgcctgacaagaactgggaaataagaaactgctatcaaggcatgtccctgttacatgtcagacccctccacacactcccacacttccgcagcacttggcacctgctgcagcaagaaaaatgcccaaaagccaactaaacaagcagtagcatttgaaggataaggggcccaatggctgggaaactgctgatgtgagaaagaccgcacagttacactcacatttgcagcaggtagtagagcgccatgagcagcttaataatgaaattttcctatagccttaagggagaaaataaaaacctgcag

SEQ ID NO: 50201 - DNA, 481 bp, Homo sapiens
ccgtacatttccaaacacctgctggggaagtggtaacacctctaatgtgagccaatccatgagtacaaaggcttaagagttttcctactagctttctcacgatgatgggcaagttgggtacaggagacacacttctcttcctaaagtcattatcatcttcaatatatttccttccttcatctttactttcatttttatgaaaatatggccatcagtgttatggctacctaaaatatggaactgaccatgttactccttcatgtcaaacccttcttcgaatgcttcccaccaaagatttccaagatagaccactatgtaggagagaggaaaaaaagcaaaagcaaaaacttgagcacacgataaagtacagcaaagtgtatatgattccacctttttaaaaagtaaatatccttacagtggtatagacagtttcgaagaatacacaagaaatccatcctagaaagattgggggtccagggtt

SEQ ID NO: 50202 - DNA, 286 bp, Homo sapiens
ggcagtcagggctcaggcaggcctggctcaggactgtgctgagacggtgacctaacttgtgatgggaagtggtgaggatgggagaggctggctgaggtcaatctgtaaggtgaggagagaggagccagtggtcagtgcacaatgtttaaaatacacaacggccgggcacaatggctcacacctgtaatcccagcactttgggaggccaaggtgggcagattgcccgagaccagcctgggcaacatggtgaaaccccgtctctactaaaatacaaaaattagccagg

SEQ ID NO: 50203 - DNA, 475 bp, Homo sapiens
gtgtttgccctggggttcttcttcctattactcccctacttatcttacctccattgtgacgatccaccctcaccatcgcctgggaagagaaagtgtcatcttgtctcctcgcgtcatcttgtctcccagtgtccagtagggcagagggggatgcccagaggcaggatgaaaaaccacagtcttcagagcttgtagagagtgcctgagaggcctggaggagacttgggacctgctttcacaactgcagagatgtggcttaccagtggattctagagaagaaagtagacaggagcaagtgcccaacacagcaaaagctggaaagaaaaagaaaggattatgttctctacccaaaacatttcagttaactaagtgtgagtttaaaatctaaagagaacgttatcagagttattaagaatgagaaatatgtacgtacaattacaatacaaaattactattaaataattaacacatggca

SEQ ID NO: 50204 - DNA, 411 bp, Homo sapiens
gttattcctcaactaaatatttctaaatgagtctgaggtctgttggccttcaatctctaccaaaacccagagaacttgatgatgcctttgttttcagagaatccttccagtgtgctggctgacagttccatgaggatggcaaaagtgaagaaattgtagcgccagtaaaaaagagatggatacacttcttgggaattttttaagctatgggacatgatgaattaatggtgcatgagtatactcttcactgtgaaagtttttgttttcacatctttcattagatgtgtgtaagaaaaagatactgaacgtagtatctactaacccaataatgaaaaggaatgccatttgctatttacactttattactaaaataaacctaaatttaattaataaattttggaaacatacttt

SEQ ID NO: 50205 - DNA, 563 bp, Homo sapiens
gtgtttgccctggggttcttcttcctattactcccctacttatcttacctccattgtgacgatccaccctcaccatcgcctgggaagagaaagtgtcatcttgtctcctcgcgtcatcttgtctcccagtgtccagtagggcagagggggatgcccagaggcaggatgaaaaaccacagtcttcagagcttgtagagagtgcctgagaggcctggaggagacttgggacctgctttcacaactgcagagagaatccttccagtgtgctggctgacagttccatgaggatggcaaaagtgaagaaattgtagcgccagtaaaaaagagatggatacacttcttgggaattttttaagctatgggacatgatgaattaatggtgcatgagtatactcttcactgtgaaagtttttgttttcacatctttcattagatgtgtgtaagaaaaagatactgaacgtagtatctactaacccaataatgaaaaggaatgccatttgctatttacactttattactaaaataaacctaaatttaattaataaattttggaaacatacttt

SEQ ID NO: 50206 - DNA, 1029 bp, Homo sapiens
cccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgt

SEQ ID NO: 50207 - DNA, 379 bp, Homo sapiens
tggggcagcatgaacggtgtccatgtaagatggtgaacttagtccagttgtctgtgttctgactgctgtactgactggccattcccacaactctctccttttcctcagacctccctattccctaagacaacagtattgaaattaggctagttaataaccctacactgctctctaattgttcaagtgagaaagaattacacatctttaattttaaatcagaagttagaaatgatgaagcttattgaggaaggtgtgtcaaaagcccagataggccaaaagctaggcctcctgtgccacacaattagccaagacatgaatgcaaaggaaaagttcttaaaggaaattaatagtgctaactccagtgaacaaacgaatgata

SEQ ID NO: 50208 - DNA, 318 bp, Homo sapiens
attatttttatttttttctgattttaaaagaaatttaaatattttatgagtccctaaaagtgtcttgggcccaggcacggggccttctcggcctgatgggcgggctggtcctagttcttcctttcaggcctcattactcctttccctcctggaaaggaggaattccctcttctctctcccctccttgcctctcctggcacccctttctgcagcgagcagagatgaaggcagagagaggatagagaacttgccttgaagcctgaagactcgagactcaacacagacctctcccatttccatggtgaggaactttgagaa

SEQ ID NO: 50209 - DNA, 320 bp, Homo sapiens
taaaaatatgataaatttgataatttttatcacatttgataaatatgatgtctcaaatagagcattatgaatttaagtattatgtgcaggtatggtgtctgtgctaataagaaatttgcaatgaataacctgatggaacaagattcttaaaatttattgaactgaagtagaatgtatcttctggcagttatacatttatgatataatgccatcatgaatggtatggtgaacatcaggctaagtgttccctgggtacagaaaaaaatcaaaccagaataacaaaggctggttaattatagtagtttctttcaaaactgaga

SEQ ID NO: 50210 - DNA, 320 bp, Homo sapiens
attagcctgttgatgtggtggattagggttacattagtagattttagaaccagccttgcatacctgggataaatctctcctggttatggtgaataattccttttctacattattggattcaatttactaatattttgttgaggatttttgttacctgtgttcatgaaagatactggtctgtagctttcttttcttaccatctctttgttttattattattagagtaaggctgctcttttagaataagtcaggaaatgttccttctgtttttattttctgcaagagattgtagagaattggtatcacttttttccttaaat

SEQ ID NO: 50211 - DNA, 374 bp, Homo sapiens
gcactcggatttttttcactcactcctttactcacacaaatatattgggcatctataactatgatagatagatacagtaggaagttggagtgatgagacggaattgtcattgacaccagctgtcccctttggaaacatctgttgaattagccaaacaagacatctgtgtcagaacagatgaataacaagggcagttgatgtgcctgagttagtggtaaagctattaagctaagtaggacttcagaatgggagatgataactggagattccttaatgagatgagactggaattgtacctccaggcatatgtgatatttgtctagacataaagacattaacatgtacggtgggaatggagtgaacacttattgact

SEQ ID NO: 50212 - DNA, 303 bp, Homo sapiens
aaaaaatcaacctggtatggtaacacgtgcagtgataaactcattatcactgtataggatgttgtcagttaggcttacttagtactcccagctactcaggaggctgaggcaggtggattgcttgagctgtgatcacaccactgccatccagcctgggggacagagtgagaccctgtctccaaaaaaaaaaaaatgaagttctgattctacaatgtggatgaaccttgaaaatacatgttaagtgaaataagccagtcacgaaaggacaaatattgtattttttccacttaggtatctagaatg

SEQ ID NO: 50213 - DNA, 350 bp, Homo sapiens
cccgaccatcttttattttttttaacctattctttgttattgctctaaaatgcaggcaaaatcagttaaagaattcttactgccttttttgagaagcttgaataaggcagtatccattttttgttgactcctaaaagtaaactgaaaagtgaaaaagcgtatatatgttatatcattattacagtcacaggaggaccgctcatggtggtccagcagacgtgcatgcaccatcagcagtccttcgagtgcttgaagaactcttggttgtttagtgctgttcagcttttggtgattacttgcttgtattgttaatcttagacctgatggcacagtatcctctgtggtctctt

SEQ ID NO: 50214 - DNA, 1283 bp, Homo sapiens
cgtatttttaactattccaagaaggaagaggtagctaaatgtaatcccctcttcctatccccccagaaaactgaactgtaagttctaggtagactaattgggagcagacacggagttttagatgccttagccaaacccagcagaaacctttcacacagccactcatcgtaagaaacgcagatttttctcttctcatgcttgtctctggttccctgcatttgtagtgacagaactttcactagcaggatataaagaaagtaattatgcttggagtccctctttactgggtttgagttaggtgcataacatggaaaggagtggtgccttcaaatgaatgtgaccactccgtattgtggagtgacttccctagggcatcctatacatcctaccacagaaggccaagggacagagcaccaacttcagtatccaagaaattagatccacaactcttgattttccacactgaggactgtcgcgagtaagttgtaagtttgccgtcttccttctggcttagcaggtgctgcagctgtactctcgactcctgtctgtgagcgtgagctcaggaaatgagagtggagtctattccaaaaaaaaaatgtgatgaagtttttcataaaagtgcattcatatgccaaatccttttgggaggattctggatgctattgttcatttctctactagtaaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgttttccaagaacttcaagttaacaattcttatgcaaggaaaagttcttaatgctaaagacttgttctgcatgaaggagacattctttaataatggaagaggtggttttatttttactacaagccgactcatatttccaaacctataaccaattgctgatctcctgtgtaaagcatttttttccttttatctgaaacagtgatttatatgaactgttggaataatggaacctcaaactacagatgtgtatgtaaaattgcataaatgcactgacttccttctccctgactatatttttaataaacagcattatcctaaaaaaaaaaa

SEQ ID NO: 50215 - DNA, 1035 bp, Homo sapiens
ggtactggctcgtatgacaaggtcgctgactgggactgggtttgagttaggtgcataacatggaaaggagtggtgccttcaaatgaatgtgaccactccgtattgtggagtgacttccctagggcatcctatacatcctaccacagaaggccaagggacagagcaccaacttcagtatccaagaaattagatccacaactcttgattttccacactgaggactgtcgcgagtaagttgtaagtttgccgtcttccttctggcttagcaggtgctgcagctgtactctcgactcctgtctgtgagcgtgagctcaggaaatgagagtggagtctattccaaaaaaaaaatgtgatgaagtttttcataaaagtgcattcatatgccaaatccttttgggaggattctggatgctattgttcatttctctactagtaaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgttttccaagaacttcaagttaacaattcttatgcaaggaaaagttcttaatgctaaagacttgttctgcatgaaggagacattctttaataatggaagaggtggttttatttttactacaagccgactcatatttccaaacctataaccaattgctgatctcctgtgtaaagcatttttttccttttatctgaaacagtgatttatatgaactgttggaataatggaacctcaaactacagatgtgtatgtaaaattgcataaatgcactgacttccttctccctgactatatttttaataaacagcattatcctaaaaaaaaaaa

SEQ ID NO: 50216 - DNA, 1225 bp, Homo sapiens
cgtatttttaactattccaagaaggaagaggtagctaaatgtaatcccctcttcctatccccccagaaaactgaactgtaagttctaggtagactaattgggagcagacacggagttttagatgccttagccaaacccagcagaaacctttcacacagccactcatcgtaagaaacgcagatttttctcttctcatgcttgtctctggttccctgcatttgtagtgacagaactttcactagcaggatataaagaaagtaattatgcttggagtccctctttactgggtttgagttaggtgcataacatggaaaggagtggtgccttcaaatgaatgtgaccactccgtattgtggagtgacttccctagggcatcctatacatcctaccacagaaggccaagggacagagcaccaacttcagtatccaagaaattagatccacaactcttgattttccacactgaggactgtcgcgagtaagttgtaagtttgccgtcttccttctggcttagcaggtgctgcagctgtactctcgactcctgtctgtgagcgtgagctcaggaaatgagagtggagtctattccaaaagattctggatgctattgttcatttctctactagtaaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgttttccaagaacttcaagttaacaattcttatgcaaggaaaagttcttaatgctaaagacttgttctgcatgaaggagacattctttaataatggaagaggtggttttatttttactacaagccgactcatatttccaaacctataaccaattgctgatctcctgtgtaaagcatttttttccttttatctgaaacagtgatttatatgaactgttggaataatggaacctcaaactacagatgtgtatgtaaaattgcataaatgcactgacttccttctccctgactatatttttaataaacagcattatcctaaaaaaaaaaa

SEQ ID NO: 50217 - DNA, 1545 bp, Homo sapiens
atatagacaaatatatagaccagtggaatagaacagagagtccagagataaaccctcaaatatatggtcaagtaattttcagaaaggatgccaaggccattcaatggggaaaggacagccttttcagagtggtgatgggggatctggatagccacatgcagaagagtgacattggacccttataacatattcaaaaattaactcaaatggacaaaaatataaacataagagctaaaactttgaaattcagccttagtttgactgctagaacaaagtaccgtagaccgggtggcttataaacagcaaacactgatttctcattctggaggtcagacatgagagaccacagtgccagcacggttgggttcggatgaggccactcttcccggtggcaaactgccaccttctcttgtggaaagagcttgctagcctccagcctcttcttataagggtactggtcccattcatgaggactccaccctcattacctaattacctagcaaagattccacctccaaataccataacattggagtatttcccatctccccccaaaaaagtgccaaatggtctgatgtaaaaggaaaaaaattcagtcactgtgctccagatctgcaaattgcacatcttgattttcagcaccataaagacaatcatttggaagatccggtgatattttttctctttaatgcaaatgttttggtgtcaagcagattgaatttgtggggagttttcctgttagtgtggctgttcactgaccattcagaaggaagaaaatgtgaaacagattgctcaagtgtaaaggagtctgaaaatgtctgtcctcaagcctgcaagatttggaaccgttctgcgtcccttttccatagatataggaataataagtctggattcagtagagtcatttgaccagccagcccctcagggtggtccctgggtctgggcagccatgctctccggagctgcccttgggggcaacttccagggccaagccagagaggccagagctctagactaacgttagagttccaagtgtacgcagcagagaagacagctatgctgttgttgtgtgtgtgtgtgtgtgtgtggattgtgccttctgtggatatcggctagggactgtctcaggaaagcctctgcctttggcgtgtttactgctgtcaaaaccctgcccacagccttatagaccccaaagaaaaatgttctcatcctactcagagatgttcaaacaggagtgattgtctgacagtgactacactcacaggagaatgacaaacagcaaggcccagctgtcccttggtaccctcaggggattggttctaggacctccaaataacaccacagtcccagcatgctcaagtcccgcagtctgtcctgctgaacccatggacaaaaaaggtcggcccctccgtatgagaggcttttccatctcatgaatacacattgggttgaaaaaaatctgcgttttagtggaacagccaggtttaaacacatgttgttcaacggtccactgtattcattcacaatacagatttcattttagaa

SEQ ID NO: 50218 - DNA, 801 bp, Homo sapiens
agggctcctggagggcacttcctaaatttgacaggtttctttataacagcaattttgcagttgttttctagagctttatcaaatttgacttctaaagctcacttttctactttagagaatgatattaagaatccctgattaaggacaataatcttcacaaactaaaaagccatccttatattcaaacatgctttaaaatgtgagcagtattctaaacttgctgcagacaacccatacaatcacatgagttattttaagaaaaagactcagttagacacatctacagaagctaatactaacgtgctgttcttccaatgaaaaggttactgacctattcagtaggagttgtcttttcctggcagagatggacagatttgccttgtccttatctcccacccccctgctgtgtccccataatgagcccatagctacatgtgcaagacagctggcaagggggagtcagggtctggtgccatgggccagagcaaagcttaccagtcaacccagagcctggacctatgaccgatgtctcattaacaccttgctctaagcaactgagctgccacaaaaatcaacagtggcttaagcattttgtttacaagtgaaacaaatcaggtcaatctgacaaccaatagttcaagcagccactagaaaattgccaaaaggacacaaaaaccaatagtaagcaggagtgataagggtcttgcagtcctagcttgggaggtagccacacaagcaaggatgagtatggaagggaatgagactgtaataggcaggtctgtttctaacatagccaggcag

SEQ ID NO: 50219 - DNA, 231 bp, Homo sapiens
gccaaaagtgactttggaaaacttttctgtcattacatattcaaaagaagtatacacttttaaccccaagtaaatagctgacctaaaatgaaataaaggcagatgaaacacattccccttaatgtaattagtaatagtaattgatatgtttcatctcctcaatattgctgtcaggggacaagggatccatttacaaagttacattccgttttgacatctgacataaatggg

SEQ ID NO: 50220 - DNA, 320 bp, Homo sapiens
gctcagagagccaaggattgtaggcacaaaagcataccaactggcttttatgttttcaaactcagcagagccaatgggaccagaaaagtagagaattgttcacattcatcaaaagttgactcatgtcttttgcaccaattctgttctccagttaaaatcataaagagtcaaaggcaaaagaaatgaagctcatcattttacagttgtgggaactgagaccaagttagattaaaatgagttgctgaagtttgtgtgtttgacaaatatttattgagccccaacatgcttggagctgggcactgtgctggagcctggaattt

SEQ ID NO: 50221 - DNA, 325 bp, Homo sapiens
ccgaggtggacagatcgcttgaggtcaggagttcgagaccattctggtcaacatggtgaaatctcatctctactaaaaatacaaaaattagctaggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcacc

SEQ ID NO: 50222 - DNA, 683 bp, Homo sapiens
ggcaagctgctgaagctctctgtgccttaggtttctctcctttatgaaactggcaagtttggaaggttgtggcaacatttacatgagataatgcttgacaaggaccttgagccacactgggacatccagggtaatgacccagtatctccctaggagctgcctgcccagtagtagcagtcagaaagttttcctataatggcaagatttgaagcaggaaaacctgtgaggaagttgttggcttcaatagaaattataaaattattttgctgaaagtttcatttaaaggtgtcactttatggaaaaaggctaccgattcaaaacaaagtttcacttccaattataatccacatttaatactgaaagaatattgtctaaaggtaattttgcaataggtttgaatgtagcctgtctcccctatttaagtatatctccttccttggataaactaattttttttttcttttcaatgtggtctaggcaggttaatggagaaactaattttattagctctctctggccttgttcttcacagcagtatccattaatgcacataaaagtagttgtaaaattcccaatactgcttttctcttcgggcctgtttgaagcaacactttccccaggacctgaagcaattggttgagaatccctgaaaattctcttgggcctatcccacatcaaaaaaa

SEQ ID NO: 50223 - DNA, 357 bp, Homo sapiens
catgtctatcatctggattctacaactaacattttattgtatttgctttatcacatacctgtccatgcagccattctttgcccatccctagcccatcttttcttaggtgtatttcaaagtcagttgcagacatcggcatacttccccctcacctactttagaatacatgttaaccagagagcaatgttgtttgtggttctgtttttcctttttgaggcaaaatttgccttcgatgaagcacacagatctttggcgtactatctgatgagtttaggaacatgcacacacctgtgtaactcacagccttatcaagataggaaaatgccaggcatggtggctcacgcttgtaattccagc

SEQ ID NO: 50224 - DNA, 606 bp, Homo sapiens
ttaaaccatcactttttcaccatttcatactacttgctaatggtttatacttgtcctgaaattttatatgcttatccaacaattcttgccagtgtccatatgcaagcagacaacagtatccatgcagtcaggatatggatttaatgcataatctgaatttcatctctgtgtttattgtcttctaagtacccatgggtagaagggacctctagaggatgataggaggtttgttcttcccagttgaaaggttttcggtgttattgaaaaattcagtgtgttttccttagtattttctggatgactattattattttatctttctaattcactagttatcattgaattttttccactgaactatggaaacaggtgcagcaagtgggtcctttgagcctttaccttccttttgagacatttcggaaccagtctctcaaggctgggtctgcaggaacactttgaatctacaagtgcagattgtctgtattgggattagagtggaaggaaggcatttggaagagggaacttagaaaatggaatgaaggaaataatcaataaaacaatttaagaaaatttctcagaaccgaagattctgtaatgaaagggcct

SEQ ID NO: 50225 - DNA, 211 bp, Homo sapiens
gtttccatcctaagtggatttatgttccatcccttcatgatgcttgcctacaaggaaggctgtattatttggaatgtattatttgggtcctggactgtattatttgggtcctagagttttttcaacatgttcatgttgatggttatgtcctttgatttcactgaggtcattacaagaagcgtctagatgaagatgattaagaagcttctgc

SEQ ID NO: 50226 - DNA, 460 bp, Homo sapiens
aagaaagcagagaccattttgcgaagtcagttgagaggcatggactagtaaatttgaagaaattgtggtgacatgctatgctgtcttacactgtgtggtaagttggaggttccatagagctcaaagctttcactgcattccactacctatctgacacactgggtcattttaacagacaaaggtgacccaggctacttttggggaattaaaaaaaaaaaaaagatactaactaacagaatttgaagtttgatctgagaaaagttccagatcaaattgagatgtgtggaatattcatattccgtaatcttcattgtgcagtcatttttatctccagttaaattcataatactcttctgttttcagaagtatttcttgtgatagggtttggctgtgtccccacccaaatctcagcttgaattgtatctcccagaattcccacactttgtgggaggaacccaca

SEQ ID NO: 50227 - DNA, 832 bp, Homo sapiens
gcggccgcgccccccaacgctccgggaggccccccgggcccgcagccggcgccaagcgccgcagccccgccgccgcccgcgcacgccctgggcggcatggacgccgaactcatcgacgaggaggcgctgacgtcgctggagctggagctcgggctgcaccgcgtgcgcgagctgcccgagctcttcctgggccagagcgagttcgactgcttctcggacttggggtccgcgccgcccgccggctccgtgagctgctgagggcggccggcgcccgcccggcgtgccggagaggagaaagggcccgactgcccgccggaccctgcacccagcgactgggccccgcgcgcgccctccgcgagggtggaggcggcggctgtgtgcgcagggcccggcaccggactgggaccctggcgtccctccaggccttgcctcctgcgggaggacagtttggcttcacttctctgaccccagcctcggccgtaaagtgaaagagaccggaccagcttcagctttcggactctggttcttggatcgtgtcctctccccctcgccgccctcttcccccaatctgagccattgcaggcctctgcctgctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcactttacaaacagaacaagacaaccgggggacacacaagacagaggggaaaaagaggcaagaa

SEQ ID NO: 50228 - DNA, 507 bp, Homo sapiens
  misc_feature (4)..(4): n is a, c, g, or t
  misc_feature (18)..(18): n is a, c, g, or t
  misc_feature (32)..(32): n is a, c, g, or t
  misc_feature (40)..(40): n is a, c, g, or t
  misc_feature (42)..(42): n is a, c, g, or t
ttgnccaaagtcgccctntaaaacgactcacnataggganancgaattcgcggccgcgtcgactgggccccgcgcgcgccctccgcgagggtggaggcggcggctgtgtgcgcagggcccggcaccggactgggaccctggcgtccctccaggccttgcctcctgcgggaggacagtttggcttcacttctctgaccccagcctcggccgtaaagtgaaagagaccggaccagcttcagctttcggactctggttcttggatcgtgtcctctccccctcgccgccctcttcccccaatctgagccattgcaggcctctgcctgctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcactttaca

SEQ ID NO: 50229 - DNA, 503 bp, Homo sapiens
gaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcactttaca

SEQ ID NO: 50230 - DNA, 777 bp, Homo sapiens
gcggccgcgccccccaacgctccgggaggccccccgggcccgcagccggcgccaagcgccgcagccccgccgccgcccgcgcacgccctgggcggcatggacgccgaactcatcgacgaggaggcgctgacgtcgctggagctggagctcgggctgcaccgcgtgcgcgagctgcccgagctcttcctgggccagagcgagttcgactgcttctcggacttggggtccgcgccgcccgccggctccgtgagctgctgagggcggccggcgcccgcccggcgtgccggagaggagaaagggcccgactgcccgccggaccctgcacccagcgactgggccccgcgcgcgccctccgcgagggtggaggcggcggctgtgtgcgcagggcccggcaccggactgggaccctggcgtccctccaggccttgcctcctgcgggaggacagtttggcttcacttctctgaccccagcctcggccgtaaagtgaaagagaccggaccagcttcagctttcggactctggttcttggatcgtgtcctctccccctcgccgccctcttcccccaatctgagccattgcaggcctctgcctgctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcactttaca

SEQ ID NO: 50231 - DNA, 2319 bp, Homo sapiens
  misc_feature (835)..(835): n is a, c, g, or t
tccgtaatggctatactagtttacattctcatcaatggtatgcaggggtttccttttctccatattcttgccaacatttgttatctatcttttttaatatagtagccattctaacaggtgtgacatggtatttcattgtgattttaatttgcatttccctgatgataagtgatattgagcattttctcatatactgagccatttttatgtgttcttttgagaaatatctattcaggtcctttgcccatttttaaatcagattatttgttttcttgctgttggattgtttaagttccttatatattttcagtattaaccttttatgagatgtatggcttgcagatatgttctcccactctgtagattgtctcttcactctgttgattgtttccttagccatgcagaagcctttttgtttgatgtaatcttactttttttgcttttgttgcctatgctttggggcacataacctgattttttcaactgtcacactgattgtacctaacattgaaatgttagaaatgtatttcagattatattctatatatatcaagcataccacttgtgaaatctgttctgatttttttcctgaatctacctggagtgtacttaatgaatgactctacttagacttcccccagagaaatgattacataataatactttgtataggacatcttataaaaagcttaaagtattttgtatatagactcattaatcattgaagtatacttagggaaatctaggtgggctgccatagtcactttatactggtgtacaaatagttaattttggtagaacagattttgttcttaatttcttctgtcagcttttngtcattagattttagagtctcatgtgctatgattactgataagaacatatatttcatcctcacatcttaaaaagaaatgagtcatgactctaaaatttttgaggtagcatttactagtttaccatgtatatgttgaaacgtttaactgttgtaagtagagataaaatagaaggtaactcttgaaagctatgccagttcccttttatctctctgtcaagaaatctattttttcactttcaaaactcagtacaggaggttagcagcagtgatggcatagttttttaatatctccaaatgcccacataaaaacagatagagtaatagatagcaaagctaaaaacctatgtactagttctggagattggagttacacaacaatgtgaatatacttaacactactaaacagttaaaacatggttaagatggtaaattttatgttatgtgtgttttaccacaatttaaaaatcagaacctgtgaacaaaatttaacacaaaactaagggaaagaatatcctcacaaactccaaaacacaaacgggcaaagacaaactaccattagccacaagacctgcatgatattagtatcttcaggagaaatcagaaagaagcaattggatgtctgacagatctaagaacaaaagaacctcaaactagctaacacgtagtaaatagaaagcacaaggggaaaatttatcagcaactgaaactagaaacagttttgtccactgccatagagtgtaagtgcaagaccctcaataagatctaaagggcttagaagagggtttctcaacctcaacactactggcgttttgggtcagacaattctttgttgtgggggactgtcctgtgcattgtaggatgtttaacagcatccatagcctctaccaactaagtgccagaagcatgtgcctggttgtgacaaccaaaaacagtctctaaacattgccagatgttacttaggggatgagaaaggggggatgaaggggaataaaataacacctggttgggaaccagctgagttagagccatctagtccctgggaactctcaaaactgaccagccaggataatcttccaggtcaggaccctacactgaggagaatcaaaattaagcaggacgagggcaacagatgcccttgttttccttgaaaagagaaagccaagacaaaagtaaggcagtgaataaagtcaataaatctctggactaggcgctgtggctcacacccataatcccaacactttgggaggcctaggtgggaggattgcttgagtccaggatttcaaaccagcctgggcaacatagcgagacgttgtctctccaaaaaataaaaaaattagccaggcttggtggcatacacctgtggtcccagttactcaggaggctgaggtgagaggattgctgggaggtcaaggctgcagtgagccatgattgctccactgcactctagccagggtaatagagtgagaccctgtctcaaaaaaaaa

SEQ ID NO: 50232 - DNA, 1031 bp, Homo sapiens
ctgagaaaatcaaatacttacagtcaactgagcattgacaaagcaaacaaaaacataaagtggggaaagggcactctattcaacacatggtgttgggataactggcaagccacatgtaggagaatgaaactggatcctcatctctcaccttagacaaaaatcaactcaagatggatcaaggaggctgggcatggtggctcacgcctgtaatcccagcactttgggaggcccaggcaggcggatcatgaggtcaggagatcgagattgtcctggctaacgccgtgaaaccctgtctctattaaaattcaaaaaatgcataggctgggcgtggttgcaggggcctgtagtctcagctacttaggaggctgaggcaagagaatggctcattaaaaaaaaagtctcaataaaaaaaaaatggatcaaggatttaaatctaagacctgaaactataaaaattctagaagataacatcagaaaaacccttctacatataagatataataaattcctcttcaaaggtttagcttgttaacttccttattctttgttctcaaactcaactttcttgttctccatgcctccttgcccctaattagtgtaaacaaccttcctatcagttctaatcaataactcacatctgttcccttggttgctaactctggcacccattccacccttcgaaaccacacgtcccaccactgtaactcacatcccccttcccttccttatttgggaaaatatccacaaatagcccaatcaggtcaacttagaatgtgcagtctgacccgcctaccccccgcccatgggagattgacacagatgtaggggccacattaggaataaccctttctctcctttgttcagtgtgctcttgtgatcgtgaatgacacgagcagcacccttctgcagaagtaaattgccttgctgggaaaacttttgcccgagtgctggtttcactttgcgaaccgagcatttatctccaacatagacattgacttaggcaaggatttcatgaccaaaaacccaaaagc

SEQ ID NO: 50233 - DNA, 468 bp, Homo sapiens
aggtgtgagccaccgtgcccagccccattgcaaataatttttgtcctgtagagttgtaatttatttttgtctggttggaaacaacaaacccaagtatccctgaaagatattaatcattaaaaatactaacattaagatagtattccagctttctttctgtcactgtgtataatgctagtctcttgcattttttatttcaagaaggtttattgtgttgcttgtttcctaattacataactaaacagaattttcacaactgctcattacatattagttttagggacctatgcttcatctttttgaaaattatgctttgacataacatgttgaaaagcttttttttaaaagcgttaaaacaattagttcttgtaataggtggatttgtgtgtggggggcagtgatagaaactcacattcacttaaatccctttaaaaagtgagtggggaaattattggatcacatgatcac

SEQ ID NO: 50234 - DNA, 389 bp, Homo sapiens
tgacccattcataacacctggggctcctgtccacaggaggctcatcactgctcttcctctggctgaggaggtcccacctgccccgcattatccccaagacctagtcttcccggggcaatggtgagcacattacctggggcagagatttgatctaaaccataaaccatttcccagaatgaactgcacccgtgtgccaagcttcaaatcaaatgttctgctgtctgtatcctgccattctttctgagaatttggtgtcacaggattgctttgtcacaaaacaatgtcaattaccacaaatgcattttgcattttgtcatgaccgtacttttcttacttataggatcataattgccatcatttacaaagtgcttaccatgtagcaggtgttt

SEQ ID NO: 50235 - DNA, 182 bp, Homo sapiens
ccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctgg

SEQ ID NO: 50236 - DNA, 392 bp, Homo sapiens
cagtaaacatttcccccattatcatacctagaatattactacagaattatttttatacactaggtaacatgctagtcttatagtgtattggtagaaactaaggcttgttggtgacagcttggtaatagtattctacagattaaagattctctttttcccagtttttggaggggccttttaccatcattttggtgcctttcttatatttccagtttctgaatattaaacgacagttaagattctaaagctctattgtccaatacagcagttaccagcccctgaaaaatcaggtttttaatcacactagttacatttcaagtgctcagtagtgatcactgtaagaagttgtactgggcaatgctgctctaaagggtagctgtggtattatgagt

SEQ ID NO: 50237 - DNA, 347 bp, Homo sapiens
gtctcttggagttgccatttttagtggattatctgccacaaggtttgagcttcaacctggtgcttactgagaaattggttaattccagccaaccttttccctcctccatgggggaagtgatgcaggagcagaggctggttcagtggaagggtggccgtgcagcctggtctccacttccacccttgccctgctgctgactttgttgcctctggcttcacctgcccatctcacaggacagccgtggttctcaagtgggggcacttggggtcctgacagatgcattcaagtatacagccagtttattattattaacagcatgttataatgcaaacaaaactgggcagttg

SEQ ID NO: 50238 - DNA, 836 bp, Homo sapiens
tagacttcttacgtggcgtcttgaggctgcaaagatgcatgtgccaagatagatagcactaagcagctgcagcctcacctgttatgacttagcctccaaagtcatgcagcatcacttcaccacattgtattgatggaggcagttacaaaggtgtgcgccattcagagggcaggacatcaactccatctgtctatggaggcgtgtcagctttacattgagcatgtaggatgggatatatcttgatgtggccatctttggaaaacaagggccaccataccatcagtgtgcccatcaatctgtctgactagctatctacctttccatgcatctctctctctacccactcacccattccatctttccacccttcagacgtctgtccttctgtgtgactgtctgttcttctgtctatcccaatcacctaacacattttgaggacctgtgtgccaggcacagctatgtgcattcaataatgagctcggagggagaatgagactaatgttgattgagaacctagtgaatgttagtcccttgatcttcaaaacaactccatgacttagaattatcatctttattttcctgggaagaaaccaagacacaagctaaataacttgcccagggtcattcagccaactaatgtcagggtcaggacttgaactccaggacttcctgactaccctgtctctgcataggatacaggctctcttttggtttctgagtgttaaatgtctactaagagttagttctccacttccatttttttcccaagcgaaaatagtttttcttccctgactataaaaataacatgttcattacaaaaacattcaagcagtaca

SEQ ID NO: 50239 - DNA, 504 bp, Homo sapiens
gatcacctgaagtcagtagtttgagatcagcgtggccaacaaggtgaaacgtcatctctactaaaaatacaaaaattagctggcgagtgtctgtaatcccagctactcaggagggtgaggatgagaattgcatgagcacgggagtgtaggttgcagccagctgagattccaccactgtactccaacctgggcaacagagcgagactcagtctaagaaaaaaaaaaggtaaaaaaggcatttgtgaacacggttgcatctcttttggggaaaatagttttgccccattgttaaacagaaataagaaagaaaccaaatggttataaagtgaatactctgtgcctggcattgttacaaggtcttgcttatctttttggtttatattgctaaatacaaacaatgagctagaaagactctgtgtgcttttttcctttagacgctttcaaactcagtttcaggggtcagaattattttgtctcgtagccctgactgcagtagtggctgtt

SEQ ID NO: 50240 - DNA, 212 bp, Homo sapiens
gaacaattaattaaaaaggaggttaattcacagtttacagacttagcatctgcttgtttagcatatgcaataaaaggcgaagttgtggtagatttgtaaaaatgtcagttagataattgattatatatataggaatcattttttgcataatccaaatcctctttttcttttgatgatcctaagatatcattttagaacggaatgtggtattt

SEQ ID NO: 50241 - DNA, 524 bp, Homo sapiens
ctgtgaattatagaactctcattttagctttaagaaatgcttaccccaacccttattatgaatgtttccctcctgcttggtttactctgtatgtttataaaactacttcctatgggccgggcaccgtggctcacacctgtaatcccagcactttgggacgctgaggcaggcggattaccagatcaggagatcgagaccatcctggttaacacggtgaaaccccgtctctactaaaactacaaaaagttacccaggcgtggtggcaggcgcctgtagtcccagctactcgggaggctgaggcaggagaatggcgtgaaccccagaggcggaggttgcagtgagctgagatcacgccactgcactccagcctgggtgacagagcaagactccatctcaaaaaccaaaaaacaaaaaacaaaaaaacctacttcctatgaaagatactcaaatacaaaggaaagaaaaagccttggtcttgttaccatggcagtagcctgagttcaagaaatgatagtggccggcct

SEQ ID NO: 50242 - DNA, 313 bp, Homo sapiens
aaaattttgaggaaatacagttttattccacgtatgaagacatgactcctcctctctgttctataactgacccacagtaagatttggagcaagtcatttatctctccacatctcacttttctttctttcttttttgagatggaattttgcttccagcctgggtgacagagcaagactccatctcaaaaaccaaaaaacaaaaaacaaaaaaacctacttcctatgaaagatactcaaatacaaaggaaagaaaaagccttggtcttgttaccatggcagtagcctgagttcaagaaatgatagtggccggcct

SEQ ID NO: 50243 - DNA, 800 bp, Homo sapiens
gcttgcgtgaatgatcacttgctgattcgaggtaggcatgatgaaggagggtttagaggagacacagacacaatgaactgacctagatagaaagccttagtatactcagctaggaatagtgattctgaggacacactgtgacatgattatgccattacatgtatggtagtgatggggatgatagaaggaagaacttatggcatattttcacccccccaaaaatcagttaaatattgggacactaaccatccaggtctagaaaagtcacatgccatagccatggtattgcacatcattcatcttgcattctttgagaataagaagatcagtaaatagttcagaagtgggaagctttgtccaggcctctgtgtgaacccaatattttgtttcgaaatagaacaagtaagttcattgctatagcataacacaaaatttgcttaagtggtggtcagcaaatccttgaatgctgcttaatgtgacgaggttggtaaaatcctttgtgcaacactcttactccctgaatgttttgctgtgctggggcctgtgcatgccaggcaaggccaagatggctcaaagagcaaccagccacctctgcagcctgccacctcctgctggcaagatttgtttttgcatcctgtgaagagccaaggaggcaccagggcataagtctactcacttatatctgtctggaacataacgcttgtttgtttttacaacaaataaaattgatcttgaataaaaacagatgcggccggacatcctcatctatattttcgttcgacataaatatgggtgtattc

SEQ ID NO: 50244 - DNA, 545 bp, Homo sapiens
tctttcattagtttttcattcagttgtatttatttaatttttatttcattttccagacctaagtcagtgttagtctaccactgtacatctggtaacctcaatccctgcaaccggggcaaaatgggtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccaggcaaggccaagatggctcaaagagcaaccagccacctctgcagcctgccacctcctgctggcaagatttgtttttgcatcctgtgaagagccaaggaggcaccagggcataagtctactcacttatatctgtctggaacataacgcttgtttgtttttacaacaaataaaattgatcttgaataaaaacagatgcggccggacatcctcatctatattttcgttcgacataaatatgggtgtattc

SEQ ID NO: 50245 - DNA, 635 bp, Homo sapiens
tctttcattagtttttcattcagttgtatttatttaatttttatttcattttccagacctaagtcagtgttagtctaccactgtacatctggtaacctcaatccctgcaaccggggcaaaatgggtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccagtttttctcaaaatctgaggagctgctacggaaagcacaccagatctcatgtgttgaaacgtgaacatgctcaccacagaccaaggacgttcaacctgtcaatccccaggatttccaagccaggggtttcatctcttacttgtggaaaatttgttcatttgattatgaaccaatcagcttttcattgtgtcaaaatcaaatctagatagtgaaactgatattttatctttattgttatcttaaatatatcttggcttaaagagacataagtggctcttccccactataccagataacaagttgcaaataaatcattcagtagtaaagttcaaagaaa

SEQ ID NO: 50246 - DNA, 609 bp, Homo sapiens
tctttcattagtttttcattcagttgtatttatttaatttttatttcattttccagacctaagtcagtgttagtctaccactgtacatctggtaacctcaatccctgcaaccggggcaaaatgggtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccaggtgagaagctgagtcaatggctttgagaatgtcactgcatatgggagattgaggccccaaagtctttagggcttccttcagccaaagattaaaggagacaactgaatctgacccatatatacagattgaacacacctactctgaaaatccaaaatctgaaattctccaaaatccaaaagttttgagtgctgacatgatgccacaagtggaaaattccgcacatcttacctcatgtgatgggtcacagtcaaaacacattcaaaactttgtttcatgcataaaattatttaaaatattgtataagattacc

SEQ ID NO: 50247 - DNA, 374 bp, Homo sapiens
gatagtgcttacatgggctctgtcacatctggatttataacacattctcccactctcatgtgaatttttctttttgcataaatcaggagcaactaattaaaaaagaaatatttaattctgacatgttctttgaactggagtcccatctggttctgtttgaatagtaaaatctgctgtagttgttaaaactggcaagtagcattgtccaaaagaaacaaaagggactcgatgcagcaggttaacactccagcatttcagctagagacttttccagaatccagctacccaaatcactccaatctggaaaccataaagatcaaatgtgaaggtgaagaatgccattttcaggtggagtcactaccattgctctgcat

SEQ ID NO: 50248 - DNA, 456 bp, Homo sapiens
tcactgctaggggatattcaaaagtaagaatttggaagatcttactaaaaggctttagacagaacctggaaatagattctctgcatttgtatgcaagttaatttttgaattctctacatatgctgagggaaaagattaggatgtctagatgggcctggatagcaaagtcagggcctgatttttttctggttagtgccttggggagattaagtgtggctatcactgaataaaatttaacccaaatgctgaaacttttagaggaaactggatacatcaaacaggaacctgttctaacatcaaatgagtgacttattttcttgcttaaccagggtaggtaacactaagctggctatcaatagccccctgtttcttagggaatttctaatacggtgtgaccatgtttattcgtagatgggacagagctgctgatggcattctaagacagagtagaagtaa

SEQ ID NO: 50249 - DNA, 221 bp, Homo sapiens
ctggaattcaatgcaagatctgagagttaaatgcccacatgccctcgcccctgtttaaactagacctctcacttagctaactgtacacatgtggaaacatgaatcagtcaggattttgttatctgtgacaggtcaaaacagcagtggcttcagaaacgtagaaattttcttctctccagtgcagacgtagacaatctggggctcctagtgtccctctgagg

SEQ ID NO: 50250 - DNA, 454 bp, Homo sapiens
agcagacttttctggaatcaacaaaaccatgtttttattgctgcagccttggcgaggaatccagaagtttcgggttggctttgaggtagccattctgttgtctgcacatctaacgtgcattcccatgcctgtttaaggtggacttttaataatctaaatggccccagtagaagacatttcagtaaattggggaatgcctatacaatgtaacagcatgtagccatgtcaaagtcccgttgaggaagaatacttagtgactgacatggtttgcacctgttccctccaaacctcatgttgaaatgtggcctccagggttggaggtgggcctagcaggaatgtttaggtcatgggggcagatcccttatgaatggctttgtgtcgtcctcacagtagtgagtgacttctcactttgttagttcaggcagagttggttgtttaaagagcctgggaccac

SEQ ID NO: 50251 - DNA, 303 bp, Homo sapiens
cagcaacatatatagatctttaaaacagaatgctgaatatagaaagtgagaaataggtactttaaaaatacataatgttctttagtgggtatatattttaatttatacaactgtggtactgtgctgttgcttattctaacaaatacattagattcctatgggagaaggaaaatataagtgggaaatgagaataaagaggaatgattaaacaaacaaccaagggagaaatagtacacccactgataacaatagtgtgccatgaactgagcaacatgattacctcaattctcggcactgcaagta

SEQ ID NO: 50252 - DNA, 495 bp, Homo sapiens
gcaaacacacccgagagctggaggaacaggtcttggggcatttgctgttgccggatttactgtgtgctgcttttgtcttggaagagtcgggaaagaggttaaagaagacacgcaagtatgatatcatcaccactccagcagagcgagtggaaatggcgccactaaatgaagaggatgatgaagatgaggactccacagtattcgacatcaaatacaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaa

SEQ ID NO: 50253 - DNA, 2091 bp, Homo sapiens
ccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaa

SEQ ID NO: 50254 - DNA, 2335 bp, Homo sapiens
  misc_feature (2253)..(2253): n is a, c, g, or t
  misc_feature (2257)..(2257): n is a, c, g, or t
  misc_feature (2278)..(2278): n is a, c, g, or t
  misc_feature (2295)..(2295): n is a, c, g, or t
  misc_feature (2326)..(2326): n is a, c, g, or t
ccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttttaaaaaaaaaaaaggttcagcagaaatcagcgtggctagttcacaaagaatttccagtatcagggaaaaactgtgcgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacnaagnaacaagcccggtggggtggcntaaaaaccccctccctnctcccaaaagggggggaaaccaaagggcccntaaaagtgg

SEQ ID NO: 50255 - DNA, 2576 bp, Homo sapiens
ccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttttaaaaaaaaaaaaggttcagcagaaatcagcgtggctagttcacaaagaatttccagtatcagggaaaaactgtgcgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaa

SEQ ID NO: 50256 - DNA, 2715 bp, Homo sapiens
ccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttttaaaaaaaaaaaaggttcagcagaaatcagcgtggctagttcacaaagaatttccagtatcagggaaaaactgtgcgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaaacagaaacactcccaccaaaaaaccagcaagatcgaccaacacccgcaccagacaaaaacggggggcgacacacgcggacgacacactgaggcagataaaataagagggcacaagagcgcgctaacctcgccgcacac

SEQ ID NO: 50257 - DNA, 1112 bp, Homo sapiens
ccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaa

SEQ ID NO: 50258 - DNA, 898 bp, Homo sapiens
ccacctcctaggaactcctagtcgttcatcatcatttcagccctttgccgccagggccaaaggtggaaagtgatttggaagagaagagcttttcgtccagcagaagaaatggtaccaaaatcagtctgtaaaggaagtaaattggggagttggcggcaaggcagagagcatagctatgatggtctcagtcagtaaggctgggccctgcaggaagtcaaatatgaatgcctagaggtgttcacaagcacaaagaaggtgtagggggaggcaagtgccaggcacaagcaggggcaggtgaggactctgggtgactgtgctatagggccccaggctacggttagccctgtaggtttcccaagggcctggcctaaggcagatccttgatcgatataccttgagaccagaaggtgctccgaaatcacaaccgtacaattaggggatctaggaacaattctttggagataccaatgcctttggctggtgttgctgcatttctttactggggactgatagatggagaggtggaaagatgagctgaggcacatctttcagagctactgggaggccatttcttcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaattatattgcacctactgcttcctatt

SEQ ID NO: 50259 - DNA, 964 bp, Homo sapiens
ctcaacttttactcagtggatcagcttatttaattgatgactgtacagttaattcatgctcaaaaatcaaacattctaagcttctttctatgaatatcttccagaccaagattattcatctcatggttttaaaggacagaatttcctggagaatgttggtcctcttgtaggtgctactgcagcaaagttgaaacaatcatacgtcagaccaaaatacaagtcagttcttcagttttcactaattaaaattaactctgtctaaataaatcaactcttaccaccttcaggattcatatctcaagtaagagacattcttactgaccaataacacaaaatatcccaccctcagcactaggatcctcagttttgaattctttcaaccatttttgtcaaaagccttgctgtagccaggtgtggtggcacattcctgtaatctcagctactcgggaggctgaggagggcagatccattgtccctaggagttgaaggccagcctgggcaacatagcaagactctgtctcaaaaaaaaaaaaaatacatgacaacaataacatgaaagccaggagaatgctaaaatgaattaaagtgtcataaggtccctagagttatttagaaaagggtgaaagtactaattcaagggtgacctaattaagccaaggatgcatgctataatatgtgggtaataaaataacaacaatagcaaacacgtgactactaatttatagaggatgaaaatgaaataattaggaaaatattgattgatccaaaagaaggcaagaaagaggtaaaaagaaacaaaaaacagatgtgaaaaatggaaaaaaatggcaaaatggtatactttaaaccctacagtatcagtaattaccataatataaatcaattaaaggcaaagattttcagactggacaagaaaaaaaaaacaactatatgctgttatagaagacacaccttaaacataagg

SEQ ID NO: 50260 - DNA, 1062 bp, Homo sapiens
cccatgatcaaatcacctcccaccaggtctcacctctaacagtgacggttacatttcaacatgagatttgaagaggacaaacaccccaaacataacagactcacttgtgactttgccctgtaaactttcagggaaaatgaggtcacttctgacccagagactctgtcatcttaccctctcctgggggtcttcatctaaagaaaccaagattattcatctcatggttttaaaggacagaatttcctggagaatgttggtcctcttgtaggtgctactgcagcaaagttgaaacaatcatacgtcagaccaaaatacaagtcagttcttcagttttcactaattaaaattaactctgtctaaataaatcaactcttaccaccttcaggattcatatctcaagtaagagacattcttactgaccaataacacaaaatatcccaccctcagcactaggatcctcagttttgaattctttcaaccatttttgtcaaaagccttgctgtagccaggtgtggtggcacattcctgtaatctcagctactcgggaggctgaggagggcagatccattgtccctaggagttgaaggccagcctgggcaacatagcaagactctgtctcaaaaaaaaaaaaaatacatgacaacaataacatgaaagccaggagaatgctaaaatgaattaaagtgtcataaggtccctagagttatttagaaaagggtgaaagtactaattcaagggtgacctaattaagccaaggatgcatgctataatatgtgggtaataaaataacaacaatagcaaacacgtgactactaatttatagaggatgaaaatgaaataattaggaaaatattgattgatccaaaagaaggcaagaaagaggtaaaaagaaacaaaaaacagatgtgaaaaatggaaaaaaatggcaaaatggtatactttaaaccctacagtatcagtaattaccataatataaatcaattaaaggcaaagattttcagactggacaagaaaaaaaaaacaactatatgctgttatagaagacacaccttaaacataagg

SEQ ID NO: 50261 - DNA, 960 bp, Homo sapiens
aagctggcttgctgagtcttctggctttcatctttctcctgtgctagatgcttctgttcattcctcctgcccttagacatcggactccaggttccttggcctttaaactcttggatttacaccaatggtttgctgggggctctagggctttggccacagactgaagcctgcacggtcagcttccctgcttttgaggcttttggactcagactgagccgctactggcttctttctccccgagcttgcagacggcctatcatgagacttcgccgtgtgatggtccaaacacaaaggcctcccgaccttagagttctgcgtctggatgtttttggctacaaaaccagaaaactccttctcaactggcttaaacaggaaaatgaggtcacttctgacccagagactctgtcatcttaccctctcctgggggtcttcatctaaagaactgccactgggatcatacagtgtgctctcatctggaacttcccacatctccacgtgccctcaccttcagtgagagtctgagaagaagccgggtggggttgctgcccacatggtcggggctgctgccaatgccactcatctcaccgtcacttgctgcctctctgcctgccccctggtccatggttctctgacatctctctctccttgaggactgtccactgagaggtctggaaacaatgacactccaggaacaatgacactccagaaacaatgacactccaggaacaatgacactccagaaacaatgacactccaggaacaatgagcacatctagcacccagatcttggcttctacacatcattctctattaaaagaaagaagcatcccttggagcaatggctgattccagagctgtggcagagaaattacaagataagcctggaacatcttgctgtgacagaaagtaagcaagtgctcaaagaattatggcaatagaaaccagcttggcaactggaca

SEQ ID NO: 50262 - DNA, 2713 bp, Homo sapiens
aacactttttgcccgcctaagcgagccatagagccgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccagcacacgcgctcgcacacacacgcacgcacgcacacacacacacacaacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctccccctccaacccccagccgtccagagtaccatgaagaattatgaggatgtgtgacagaggtatccagatgttgatcaccactgtaggagcctttgccgcttttagtttaatgaccattgcagtgggcacggactactggttatattccagaggtgtgtgcaggactaaatctacaagtgataatgaaaccagcaggaagaatgaagaagtaatgacccattcggggctgtggaggacctgctgcctagaaggggctttccgaggcgtgtgcaagaaaatcgatcacttccctgaagatgctgactacgaacaggacacagccgaatatctcctgcgagctgtgagggcctccagtgtcttccccatcctcagtgtcacgctgctgttcttcggcgggctctgcgtggcagccagtgagttccaccgcagcagacacaacgtcattctcagcgcgggcatcttttttgtctctgcagggttaagcaacatcattggcatcatagtttatatatcagccaacgccggagaccccgggcagcgtgactccaaaaaaagttactcctatggttggtccttttatttcggagccttctctttcatcatcgcagaaattgtaggagtggttgccgtgcacatctatattgaaaaacatcagcagttacgagccaaatcccactcggagttcctgaagaaatctacttttgcccgcctcccaccctacaggtatcgattccggaggcggtcaagttctcgctccaccgagcccagatcccgagacctgtcccccatcagcaaaggcttccacaccatcccttccactgacatctcgatgttcaccctctcccgggacccctcaaagatcaccatggggaccctcctcaactccgaccgggaccacgcttttctacagttccacaattccacacccaaagagttcaaagagtcactgcataataatccggccaacaggcgcaccacgcccgtctgaactgacctctgacctctgccccacgcccagcacagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgtaataagcactcatgttattaaaggttttgccttgtcgtaaccaaccgaaacggggg

SEQ ID NO: 50263 - DNA, 1480 bp, Homo sapiens
  misc_feature (16)..(16): n is a, c, g, or t
  misc_feature (19)..(19): n is a, c, g, or t
  misc_feature (26)..(26): n is a, c, g, or t
  misc_feature (45)..(45): n is a, c, g, or t
ttttccaggtgccccngtngagtctntttacctcacatagaaggntcctacagtgggcacggactactggttatattccagaggtgtgtgcaggactaaatctacaagtgataatgaaaccagcaggaagaatgaagaagtaatgacccattcggggctgtggaggacctgctgcctagaaggggctttccgaggcgtgtgcaagaaaatcgatcacttccctgaagatgctgactacgaacaggacacagccgaatatctcctgcgagctgtgagggcctccagtgtcttccccatcctcagtgtcacgctgctgttcttcggcgggctctgcgtggcagccagtgagttccaccgcagcagacacaacgtcattctcagcgcgggcatcttttttgtctctgcagggttaagcaacatcattggcatcatagtttatatatcagccaacgccggagaccccgggcagcgtgactccaaaaaaagttactcctatggttggtccttttatttcggagccttctctttcatcatcgcagaaattgtaggagtggttgccgtgcacatctatattgaaaaacatcagcagttacgagccaaatcccactcggagttcctgaagaaatctacttttgcccgcctcccaccctacaggtatcgattccggaggcggtcaagttctcgctccaccgagcccagatcccgagacctgtcccccatcagcaaaggcttccacaccatcccttccactgacatctcgatgttcaccctctcccgggacccctcaaagatcaccatggggaccctcctcaactccgaccgggaccacgcttttctacagttccacaattccacacccaaagagttcaaagagtcactgcataataatccggccaacaggcgcaccacgcccgtctgaactgacctctgacctctgccccacgcccagcacagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgtaataagcactcatgttattaaaggttttgccttgtcgtaaccaaccgaaacggggg

SEQ ID NO: 50264 - DNA, 1233 bp, Homo sapiens
tcacagcagccttgatctcctgggctcaagtgatcctcttgtctcagtccttgaacagctggggaccacaggcatgcaccaccacgctcagtgaattgttgttgttattgttattgttgttttgtagatacagggtctcactatgttgcccagcctggtctcgaactcgtggccttaagtgatcctcctgccttagcttccccacttttttttatgtcttaatcacttggttaaggtgattttctgccaggcttttccattgtaaagttaccaattttcttttcgtaatcaatgatttgttggaagatgctttgagactagagtttattctttaacccctaaatatttgagtgtattacctataaacaaagaatttcccattcattactgtgatacagttaacaaaatcaggaaattaatctgaaataggtcctcagtctttttgtttcattacattgactctttttttctttttaaaatagggatgtgggatttcactatgttgcccaggctgaagtgcagtggctactcacaggcacgatcctagagcactgcagcctccaacgtcctggggctctgatgatcctcttgcttcagcctcccatgtagctgggactacaggcataagtcaccacacccggctaattaaaaaaccgttttttttcagagacagggtttagctcttgtccaggctggtctcagactcctggccttaagctgtcctgcctcatcctcccaagttgctgggattacaggcctgatacactgtgcctggctagcaaatctgtttcagagtacagttgtccctcagtatctaggggggaccaaaatccatgcatactcaagttctccagttggctctgtataggtgaagtctgcctgcatgtataaaaagtcaaccttcatataactgggttttgcatcctgggaatactgtatttttgatcctcatttggactcgggcagttcaaactcactcatgttgttcagggtcaactgtatttccatataacttaactcagttccttctgaatactttaagtcatctctaggttatttataatacgatttaatgctatgtaaatagttgttatgctgtattgcttagggaataatgacaaaaaaagtctgtacatgtttatacagatgcagtttttttccaaatattttcaatctgtgattgtttgaatctacagatgcagaacccatggatacggtgggccaatcgtatat

SEQ ID NO: 50265 - DNA, 476 bp, Homo sapiens
cagcatcggtttacgaaccctgctgattgttcagctagcaccatggatcagggagtaatctagatgcataactcagagatactgctggtctggttccagaccattgcaatagcaaatatcacaataaagcaagtcacactaattttttgatttcccagtgcacataaagttatatttacactatactgtagtctataaagtgtgcaataacatgtctttaaaaagtatatatcttaattttaaaatattttattgctaaaaaatactttgtaaaaatgcttatagtcatccaagctagatcttctggataaattgttgcagcttctccatcagcacttgctgcctcactttgcactttcaccttacggagatggcttagtttcctaaacttcatgaacccaacttctgctagctttcaacttttcttctgcagcttcctcacctcacccagccttcatagaattgaagagacttgg

SEQ ID NO: 50266 - DNA, 276 bp, Homo sapiens
cgtcttttaagggaaacctgggtatcagttctaaaaatacaggagatctcaatcttagggggagatcatgctagagacagaggaatagatgagctggcctttgcatggaattccattgctaaatcttactccctcatctccctctttacccatgtacctcccaccactggcagcctttcagagctcagttagtggaacaggagggtatagcagttctaagagatcatacaggaaggagacagcgaaaataataactcattctgagcactgactacg

SEQ ID NO: 50267 - DNA, 530 bp, Homo sapiens
aaggtgaacaccaaaaagtaaaaagtctgggtaataaaatctacagtagggaaagaaaatgcttctgataacttcagtgaagcttgcagtttcagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaagggggtttcatcaaggaacggatttggcatttgggaaa

SEQ ID NO: 50268 - DNA, 817 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggatagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatc

SEQ ID NO: 50269 - DNA, 2927 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggatagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattaaaaaaaaaaaaaaaaacaaaaaaaaaacaaaacaaagacaaagacacagaacaacagacgacaagacgaccgacccaaccgctacagcggcgagcgagagcggcgagaagcaggaacacaaagccaacacgagcgcgacaaagaaccagaagcggggcgggggagcaaccacacggcgagagccgcaccgacgacacgcaaccaaaacaccaaaacgatattaggaaacatgcaggagcacaacaagaacacgataacaaatcaaacaggcgacggagaacgcaaccagaaccaacgacgaacacaaaagaaggtagaagcagagaagagaagaagacacaatcacgaggggaacagaaacgaccacaccacaagaaaaaaccacaaacaaaaacaagcagcaagtgaggaacagaacaacacccgcgaaagagcaaggtaggcaacaaacg

SEQ ID NO: 50270 - DNA, 1599 bp, Homo sapiens
  misc_feature (52)..(52): n is a, c, g, or t
aataatcaatatcgttaaataaaaatattgggattcgcgggaagcccctganaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattaaaaaaaaaaaaaaaaacaaaaaaaaaacaaaacaaagacaaagacacagaacaacagacgacaagacgaccgacccaaccgctacagcggcgagcgagagcggcgagaagcaggaacacaaagccaacacgagcgcgacaaagaaccagaagcggggcgggggagcaaccacacggcgagagccgcaccgacgacacgcaaccaaaacaccaaaacgatattaggaaacatgcaggagcacaacaagaacacgataacaaatcaaacaggcgacggagaacgcaaccagaaccaacgacgaacacaaaagaaggtagaagcagagaagagaagaagacacaatcacgaggggaacagaaacgaccacaccacaagaaaaaaccacaaacaaaaacaagcagcaagtgaggaacagaacaacacccgcgaaagagcaaggtaggcaacaaacg

SEQ ID NO: 50271 - DNA, 1285 bp, Homo sapiens
cacgcgtccgtgaagccttaccaaaggacgtgtctgaggatccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattaaaaaaaaaaaaaaaaacaaaaaaaaaacaaaacaaagacaaagacacagaacaacagacgacaagacgaccgacccaaccgctacagcggcgagcgagagcggcgagaagcaggaacacaaagccaacacgagcgcgacaaagaaccagaagcggggcgggggagcaaccacacggcgagagccgcaccgacgacacgcaaccaaaacaccaaaacgatattaggaaacatgcaggagcacaacaagaacacgataacaaatcaaacaggcgacggagaacgcaaccagaaccaacgacgaacacaaaagaaggtagaagcagagaagagaagaagacacaatcacgaggggaacagaaacgaccacaccacaagaaaaaaccacaaacaaaaacaagcagcaagtgaggaacagaacaacacccgcgaaagagcaaggtaggcaacaaacg

SEQ ID NO: 50272 - DNA, 2122 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggatagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaagggggtttcatcaaggaacggatttggcatttgggaaa

SEQ ID NO: 50273 - DNA, 441 bp, Homo sapiens
gatggcaatgatcagtgggagaatgaggtggggaagtgggtaaccaatgtcagaaaactcagaatgtgtctgccagggatgggcatggcgtccacccaatctcccaggggaaaggagacctgcactcaccccagcacctccctcctcagttcctatgaaaaggcccagtttggcccctgattcctgctcagctctcagtcccttcattatgtctccttttagcatctccaaaaccccactcagaattctacctggtccctgacgcctgtcctggctgccccactcaaatgatttatcctacctcggagcttacagaacatccccaactactcaagagccaggcttagggtgtacagaatctggatggaaaagtgtgcaggagcagggagtggggagcctgatgcccctgtcaggccatatccaccctcttgccagctgagc

SEQ ID NO: 50274 - DNA, 558 bp, Homo sapiens
ttaagtgaagtgtttctcccaggtgtgcacagggtgtggcttccaaggggaatgtggatgctggaatgagggaggcagccacctaggccggtcaagtcagaggcccagcaaggagaaagcgagccaaggcaaacgccgacagaagagaacgataaatccgcggcgcactcggcagaacgtccaccgcaccgcataatttagcggggcaatgccgccgggagtccacgccaagttaatggaatatttcctgtaaatattattttcccttcctgtctcatcatctcatttcattcaaaaatctttactaatccgggggagtgaaagtaatgcatcaatttccagagccaatgcccctgcttccgaaatacccttaggaatcactggaagccaccgcggctgcttagggacaggggggcaggccgtttactctggttccttctcctaatgcctcagaggggaccccatagtgctcctaattgtgcatctaagtgtacataaaagcccccctaattgcacatcaaataaataagtaaatgctgtctgctgaatatgtaacaa

SEQ ID NO: 50275 - DNA, 600 bp, Homo sapiens
ttaagtgaagtgtttctcccaggtgtgcacagggtgtggcttccaaggggaatgtggatgctggaatgagggaggcagccacctaggccggtcaagtcagaggcccagcaaggagaaagcgagccaaggcaaacgccgacagaagagaacgataaatccgcggcgcactcggcagaacgtccaccgcaccgcataatttagcggggcaatgccgccgggagtccacgccaagttaatggaatatttcctgtaaatataggttggtgtatgtcatcccattttgcagaggagaaattgatgaaagctacctggctagtcactgcagaggcttggctgggatgctaagacccactgccttggttaccaggctgcagcctgcaggttgcccatccaatgtgcgaactccagcgggggcaggaaagcccccgaagaatggtgctgtttgctttctggtcttaataaatctcatgctgggagaatcctgttttagtgattagcatcagtatatccagtcctcggaaacaaaaatatttccaggtcccagaagagggtccagagtaacacagctttactgatctggtttcaataaatcttgttaac

SEQ ID NO: 50276 - DNA, 511 bp, Homo sapiens
ttaagtgaagtgtttctcccaggtgtgcacagggtgtggcttccaaggggaatgtggatgctggaatgagggaggcagccacctaggccggtcaagtcagaggcccagcaaggagaaagcgagccaaggcaaacgccgacagaagagaacgataaatccgcggcgcactcggcagaacgtccaccgcaccgcataatttagcggggcaattattttcccttcctgtctcatcatctcatttcattcaaaaatctttactaatccgggggagtgaaagtaatgcatcaatttccagagccaatgcccctgcttccgaaatacccttaggaatcactggaagccaccgcggctgcttagggacaggggggcaggccgtttactctggttccttctcctaatgcctcagaggggaccccatagtgctcctaattgtgcatctaagtgtacataaaagcccccctaattgcacatcaaataaataagtaaatgctgtctgctgaatatgtaacaa

SEQ ID NO: 50277 - DNA, 428 bp, Homo sapiens
acgtaaggtctgtagagagtccgggaacacagcagtgccccctcagaagagagtgggcagctactgacagctcccagcgttctccccgcaggatcctaaaatagatggcacttaaaggccttggttgagggtgaggagggtgctggtttgtggtgggtaacacaggcgtcttccatgaaggacagcacacagtgcctgctttgtagctgtggccagaacaggagcgcacgcaccagcagagaccttggcttactcctcttggtcgctcttactgccgttaaattgtattctactgaaattcttgtgattctcagcaaacacagtgatgtttcttttgtccaaaggacaaacgtggagttatcgtagtggttaaaatactcattgggtcttacctgtaggaagggaagaaccaagccaaggactgtggc

SEQ ID NO: 50278 - DNA, 579 bp, Homo sapiens
gacggcgttttgttcttgttgcccaggatgtagtgcagtggcgccatctcagctcactgcaagctccgcctaccacattcaagtgattctcctgccgcagcctcccgagtagctgggattataggcacccgccaccacgcccggctaattttttgtatgtttagtagagacagggtttcgccatgttgggcaggctggtctcaaactcctgacctcaggtgatctgcccgtctcagcctcccaaagtgctaggattattggcccaaagtatattcttaatctgccagttcttaactgccttacagctataagcctagctcaagcccctactgtctcacactcctactgtctcacatctggactaaggcagaaacccaggaatgggcttccctgattctctttctgaccttcagtagtccattctaaacatagcaaccacagcgagcattcagtaactgaaatgtgatcatgtgcctctcccctgcttcccactgcagttagagtaaaatccacactcctgcgggcccagtgtgatggggacttgctaacctcctaataaaaagaaaaacatttttaaaa

SEQ ID NO: 50279 - DNA, 402 bp, Homo sapiens
aatcagctcggtacctaggggcttgagctaggcttatagctgtaaggcagttaactggcagattaagaatatactttgggccaataatcctagcactttgggaggctgagacgggcagatcacctgaggtcaggagtttgagaccagcctgcccaacatggcgaaaccctgtctcacatctggactaaggcagaaacccaggaatgggcttccctgattctctttctgaccttcagtagtccattctaaacatagcaaccacagcgagcattcagtaactgaaatgtgatcatgtgcctctcccctgcttcccactgcagttagagtaaaatccacactcctgcgggcccagtgtgatggggacttgctaacctcctaataaaaagaaaaacatttttaaaa

SEQ ID NO: 50280 - DNA, 421 bp, Homo sapiens
ggttaatcaaccgatatgaacagtgctgacctgtagccctgccacatccccgcagtgagagcaagacaaggcacaggagagctgatcccaacacatatctaagcccatgggtcacagcaggtttcaaccatttagagaagaattttggattcttcattgttgcctgttcttatcaatgttactgattcattcagttcattcattcaacagatgtattttcagttttctgctaatatgccagacacagtgtaccagagactctgtggagggcagaaattaaccaggtggagggaagagcattctgggagatgggaatagcaggtgcaaaggcctggcaaataggagtctggcggaggttgcagtgagctgcgatcacaccactgcactccaccctgggcaacagagtgagactctgtctcaa

SEQ ID NO: 50281 - DNA, 782 bp, Homo sapiens
accccttagtggtgtccccattagggactcctcctatctgccccacagcacactgcagctcggcctttttactgtctccgccaactagactgcaaggtccatacattgtccccatggcaactagagcataataagtgttcagtaaagatttgttgagtcaatgtgtgaattttttgtttttttaagagacagggtctcctgctgctgcccaggctggtctcggaactcctgggctcaagggatcctcctgcctcagcctcccaaagcgcaaggattacaggcatgagccacaaggcagggccattgtgtgaattcttaacttgcaaatcagtcctgtcctcggccccctaaactcccacaaaggcttcatcatagagccccagctcctagcagggcatggaaggccctccatagtgaggtccccgctgactcctccagcctcactcctccaattcctgccctcactatcttgtaacacaacaagactcgtggcacagcacgtaagatgcagtttccagcctccatactttgcccagctatccccctcccctcctgggtaggaagttttcctgacaccccaccaagaccaccacaagtcaggatcttttctgggcattgtttgtttgttttgttttgttttgtatcagaatctccctctgtcacccaagttggagtgcagcggcatgatctcggctcactgcaacctctgtctcccaggtccaagtgattctcgtgcctcaacctcccaagtagcttggactacaggtgtgcaccaccatgcc

SEQ ID NO: 50282 - DNA, 888 bp, Homo sapiens
tccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccacctgctgccaccctagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccacctgtccccgccccgtgtgctgcgcctcctcttgctgctgagcccactgccctggctcatctctcccttcgccgctggtccacaaatgtagaccattcttctgtgctgaatattaggacacatggagtgggattgatgtcattcagcagggtggacctcatgtatccaatgagcccatcaccatcccgctgactctgtgagaacattctggttcattttaaactccctcccttgctttatttttcttccagtcatggcaccaaatacgaattaatttgtaatccactagctaagaaataattccaatcctctaaattcctcattttttaaaatcattttgagcctacagaatatccttcccaattaggtacacattatctccctttcaaacatactatttgtctgtcagcctttcagtcattcttttcttttggaaaggtaggaggctgcccctcccgtgctctcccgctttctccctgctccctctttctctcactgttcaagtttgccagaatttttctattttattagttctttatctttattgtgttcacaaaatatattgtattaaacttttcatttag

SEQ ID NO: 50283 - DNA, 214 bp, Homo sapiens
agtttagtggcagagggaggaaatcagagcttttgcctggtggatcacatttccttggagaagtagaattcaagggcttggactgaaagtaaaggtggtggggttgttgcaggcttaagttcaggggcaatggggagaaggtcccttctgtgtttcccatgtatgttcttatgtgaagaagggttgcccgggcctaggagtgtggagcttgtag

SEQ ID NO: 50284 - DNA, 233 bp, Homo sapiens
gacgtgagcagttacatcataaaaagaagaaatgccactcaaacctgtgattgccagtttaggagaggctttgcctcttgggccattgcttcatgttcccattttgggtgccttgtctataaaggggaggaaggggtgtcgggatggctctctgggttggatagcgggaggagactgcagcccacatctggttccagcctcttgtcacacagttgagggagtggagcccagct

SEQ ID NO: 50285 - DNA, 4707 bp, Homo sapiens
  misc_feature (1)..(2): n is a, c, g, or t
nngggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctatttagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaatattttgtgacagtatttgaatcagcagttgtaaaaaatcaacctcatactgaatgcactatcagcaaattaaaataatctaacatccaca

SEQ ID NO: 50286 - DNA, 3486 bp, Homo sapiens
  misc_feature (1)..(2): n is a, c, g, or t
nngggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataact

SEQ ID NO: 50287 - DNA, 4542 bp, Homo sapiens
  misc_feature (1)..(2): n is a, c, g, or t
nngggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaaatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctatttagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaatattttgtgacagtatttgaatcagcagttgtaaaaaatcaacctcatactgaatgcactatcagcaaattaaaataatctaacatccaca

SEQ ID NO: 50288 - DNA, 4359 bp, Homo sapiens
  misc_feature (1)..(2): n is a, c, g, or t
nngggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctatttagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaatattttgtgacagtatttgaatcagcagttgtaaaaaatcaacctcatactgaatgcactatcagcaaattaaaataatctaacatccaca

SEQ ID NO: 50289 - DNA, 2272 bp, Homo sapiens
ctttttttgaaactgaattctgctccaccacagtcttaccctggtgtttctgcaggatccacatcagaccctgcttcaggtgtggatgtcttagttaatcaggtggcactgttgatcccccatcaatggacttctgagatcaccaccattatttcctcaatttgtttgactctttctctaccatgcattcatctgtgagaaggttaacgcgtgattctcatgacaacgtgattggcagccacaaagtctaagagactcctcagacaacctctaacaaacagccattaacaaactgaacacacctaaaatgtcactgatttgtcttggaagacagaatactaagcaagataaatggcactatacatatagataatttgtgtatgtaagactattagttcattagataactaatctcactactttatttaaaagaaaatgtaagtaggaatccatttctaaatcttttcaaattacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctatttagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaatattttgtgacagtatttgaatcagcagttgtaaaaaatcaacctcatactgaatgcactatcagcaaattaaaataatctaacatccaca

SEQ ID NO: 50290 - DNA, 1730 bp, Homo sapiens
  misc_feature (1)..(2): n is a, c, g, or t
nngggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaagtaaggtcaggcgtgaagcccgtttacattattttggttcttgttggtgctaaataaggataaagggttgatattgttagattaagctgggattttcttttcttttctctttttttttttttgagatggagtctcgctctgtcgcccagtctggagtgcagtggtgcgatctcgg

SEQ ID NO: 50291 - DNA, 480 bp, Homo sapiens
ctttgcagcttaaaacaacagtaatatttatttactcatgattttatgatttttgtaggactcattgagggtagtttatcttcgtttcatctggtgtcagctcagtgggggttagattatctacttccaaatggctcacttacatagctggcagtttatgctggctgctgtccaggagctcagctagggctatttactagaggtactaaatgaggccttttcctgtggcctggccatgactggtagtttctaagaaggagtgctctaagaacaagcatttcaagaggcaaaaagtggaaaaacctagtccccttaaaggctaggctaggaactgatagagcattacttctgctgtattttgttggctaagaagacagagtcagcccagattcaagaggaagagaattaaactccatctattggtggagaaaatgacaaagaatttgcaactttacttaatttgctacacaaacttaaaat

SEQ ID NO: 50292 - DNA, 492 bp, Homo sapiens
ttgggctgctttgtcctttatcttatttcataactgttaggcaggaagaccagttacctactaagtacgttactgtagtgaggacagagggaagctcaaacaaggctgaatcttaaaactcttactgagcaatgggtgggagcatttaatactgaattactgtaatataggagagctcgttgtatggatttttaaaacttttttcaggctgggtgtggtacctcatacttgtaatcccagctctttgggaagctgaggtgcaaggatcacttgaggccagaagtttgagaccagcctgggcaacatagtgaggctccatctctacaaaaaaaacttttagtgagctgtgtgtgatagcgtgtgcctatagtttcagctgcctgggaagctggggcaggaggattgtgtgagctccagagttttgaggctgtagtgaaccgtgatcgtgccactgcactctagcctgggcaacagaggggacaccctgtctca

SEQ ID NO: 50293 - DNA, 291 bp, Homo sapiens
tccatctcaaaaaaaataaaaataaaataaaataaaaagtaatcactgtcttctaatggaagtttctgttgccttttgctaaacatctaaagtactttaagattatattttagcacataatttgtgcgcttatccaagatcacctttcaattttcaaacacttcttaggattttctagtcactaaggtgaactggaagcgagttggaccgaacacaaattttacttagtcttgaaagaagaaatataaatggctaagtaatgtcagggtagggaggaggttcagcttcatt

SEQ ID NO: 50294 - DNA, 222 bp, Homo sapiens
cttgagcccaggaggtcaaggctgcagtgagctgtgttcatgctattatattccaggctgggtgacagagggagaccctgtctcaaggcaaaaaaaattgttgtaaacttccaggcatctcagatattttttttaaaaagaaagaagtgcaaagattgaacagctggtttcaagtttagaagaatgttttggtcactggtattagcttggaattgattgatc

SEQ ID NO: 50295 - DNA, 439 bp, Homo sapiens
atatgtttatttagtttttataatgtcatgtgtcacttaacgatggggatatagtctgagaaatgtgtcattaggaaatttcatcattttgcagacatcatagagagtacttacacaaacctcatggtatagcctactataccccaaggttctatggtctagcctcttgctcctaggctacaaacctgtactgtatgttactgggctgaatactgtaggcaacttaaacacagtggtatgtatccaaacatagcaacagtatagtaaaaatacagtcttataatcttatgggaccactggaatatatacagtctgctgtcgactgaaagcatcattgtttggcagatgactacatgtgacattacagtgctttttttttgagatctcaccattgcaaccccagcctgggcagcaagagcaaaattccatctcaaaaaag

SEQ ID NO: 50296 - DNA, 312 bp, Homo sapiens
attatgtagtagatattgtgattatcctcattttacagatggagaaactgagacttagacaagttaaataacttgcccagggttacaatattactgagtagaaaaaccacatttgaacccaggaagtgtggctgaagaatttttgtgatttacctgttagactataattgtctattttttctacagtggagataattctggtgtcaaggggctaaagaattttctcaagaccaaacaacacattttttggaaatacacagtaattgaccatgagacatgctgagcttagtactgagtgagcttttgcttaaa

SEQ ID NO: 50297 - DNA, 336 bp, Homo sapiens
gtaacgagtaagttctcactctgctggttcatttgagagctggttgtttaaaaagagcctagcaccttttttgcttgctctctcaccacgcaacacacctgctcccccttcaccttacaccatgatgggaagcttccttcggcctcaccagaagcagatgctggcaccatgcttcttgtacaacctgcaaaaccatgagctacataaacgttttttctttataaattaccaaacacaggtattcctttatagcagtgcacaatgaactaatacagatggggtttcactttgttgcccaggctggtcttcaactcctgacctcaagcaatcctccca

SEQ ID NO: 50298 - DNA, 491 bp, Homo sapiens
gaacggaagagttttccctcctccgtgctcaccgctcgcctgtttgtccacgggtgtgtccggctgtgtccattgccgtccccttttaatatgctgccctgccagggctcctgcccttatgatgtgcctgacagtttctgcacccttgcttgctttctggcacccagatgctcccagcacccggcggctctgggacagccgctcctggctccttatgggtgtgtttaagactcagggtctgggccgggcgcggtggctcacacctgtaatcccaacactttgggaggccgaggcaggtggatcacctgaggtcaggagttcaaaaccagcttggccaacatggtgaaaccccatctctactaaaaatacgaaaagttagccggttgtggcggcaaatgcctgtaatcccagctactcgggaggctgaggcaggagaattgctggaacccgggaggtggaggttgtggtgagctgagattgcgccactgcac

SEQ ID NO: 50299 - DNA, 298 bp, Homo sapiens
gcttgcctttccttttttatattatctaccatattagaaaatgcagagggaagagttagtgcaaattgggaaagtgagtaccgatgcatttgtactcctgattggtgagcaaaataaaactgctcagcctcctataggattaaagtagaacttacactggagatgtttgatctttctgtataaatgtttgtgataaaatcatgcttatttaaaataagaagatcaggaatgatagatataaaattaactggattcagattttctgagattttagaataggatgtcagctatttaccag

SEQ ID NO: 50300 - DNA, 303 bp, Homo sapiens
ggccacacatataaggaaagtttgtccaatcctttcctcaataaagatcttttgtaaagtgctatggaaactcatagaggcctcaaagagattaagggtgggactctcctaggactttcaaatatatatgtgtgtgtgtatgtgtgtgtgtgtgtatgtgtgtgtgtgtaatctttaaaaagctaaatggtattaaataaatgctcaggaaagaatatgaattccttgttttgttttgatcattttagatggtttctccaacctgtaaaagaaggcagttcaggctgggcgcagtggctcacg

SEQ ID NO: 50301 - DNA, 2163 bp, Homo sapiens
  misc_feature (641)..(642): n is a, c, g, or t
  misc_feature (645)..(645): n is a, c, g, or t
  misc_feature (654)..(654): n is a, c, g, or t
  misc_feature (659)..(659): n is a, c, g, or t
  misc_feature (662)..(662): n is a, c, g, or t
  misc_feature (667)..(667): n is a, c, g, or t
  misc_feature (729)..(729): n is a, c, g, or t
ctggcatctagaatgcagtgtaggcagcagtgtgcctgggagacaagcagagatctcacggattcctttatttttcctgccatagcagcaaattttccttggagcactatttgaaaattaacattactgaaaaaattaagcccacttaaagggactctagtttttatctaaattataaaaggtgagaagacagttctgaaaaaaatgtatcaccttgaaactagaatgctttagttaatggggtaagctagaagtaagctgcctttgataactcatgtaagagcagcatatgaatggatgataactgtctttcttccatttaattcagctacttcctattcaatctcaaatctcagttggaaagcaatttccctcacttgacccatttttcttctgcattatatctttcttctggttcttcaacacaaaaagtttgaaaagacttgtaagcagattcagacacctggtttgggctaagcgtatttcattatttggctttccagttggaaggataacagttttacttctttacattttgttttgtttcttggttctttttgagacaggttctcgctctgttgcccaggctggagtgcagtggtacagtcacagctcatcgcagcctcagcctctcaggctcnngcngtcctcccncttcngcntccanagtagctgggaccacaggcatgcactatcatgcctggctaatttttaaaattgtttttgtanagacagggtcttcctatgttgctgggattgcaagtgtgagcaacctcacctggctgctgctttactttgatatcacaactttcaggagagatatatgttaaatgactgagactggtatagagtcatatgggtatagaccaagcttgcccaacctgcagcccgggatagctttgaatgcggcccaaaacaaattaataaactttcttaaaatactatgagatttgtgtgtgtgtgtgtgtatgtgtgtgtttaagctcatcagttattaatgttagtgtattttatgtgtggcccaagacaattcttcttcttccaaggtggcccagggaagtcaaaagattggacacccctggtatagataaaagcaggtaattggcctagcctgggcgacacagcaagacccttgtcttttaaaacatgaaaaaattagctgagcatggtggcacatacctgtagtcctagctactcaggaggctgaggtgggaggatcacttgagctgtggagttcaaggttacagtgagctacgatcctgccactacactttggcatgggtgatagaccttgtctcagaaaaaaaaagaaagaaaagaaaaaagtaggtggggggtataaaattcttgttttagtaacacgggcaatgtaaagatgttataattttagtaaagatatatgaaataagcctcacatatccatattgtaaaatgtctatctgagacccaagtctctggaatttgttatctaaattaatctattagtggtatcattaacacatgcattagttacaggtgtcttgtaataacatttatttcacaccttgggtgataaagtgcttgaattggtttctgtctttgccagatcaaattctaaatttcctaaaatagctaacatgaaaccagtctcctttatgaacccttctctgacttctctcatgataaactttctcttctctattcattcctttggtcatctcattcagtcctgtgacattaaataccacatacgcactgaagacaccaacctagactgctccccagactcaatatttccatatccagttgcctgttccacatcttgatggctttttaatgggcatttccactgaacagatccagaactgcacccctgttcttgccccaaaataacctcaggaggttattttgtcttcactgatgaattctgtcaaacatagaactaatatcgagccttcacaaacatttccagagattaaaatctgctctgcttgcattccttcccactcactgaaaagcactgccatccttccagttgctccactcaaaaactttggagtccccattgacttctctctttcactccatgtatgtccatcagaaattaagtaagagatttctgaataacccataggttaaagaagagctcacaagggaaaattagaagatatttttaagtgagtt

SEQ ID NO: 50302 - DNA, 446 bp, Homo sapiens
ctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacgtgaaggagactgagggccacagagttcaatgcagggcctagtttagactccagaccagctgccaagagagatgaagggctggtggagaccagccagcaagtggccatgctgcctgctgcagaccccacttcaca

SEQ ID NO: 50303 - DNA, 13938 bp, Homo sapiens
ctgggattgggacacactttctggacactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 50304 - DNA, 13964 bp, Homo sapiens
ctgggattgggacacactttctggacactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatctgaatggaagagtccaatccaccgaatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 50305 - DNA, 822 bp, Homo sapiens
taaacctctcacaaagcccaacacctaacatatgctcgatcaactttaaacatgaaccaagaggtggtattgagggaacaagagaagaagggtgttttgggtcattcatcactctgccaataacctcaggcaagccaaaacaccgctagacagataaggggaattaatattttccaacttaatgacgtcaaggtacactgaactttatttcactgacaaaagaagtgaatcaatttgtaaatggtactgtttatgaatcaattggcattcttacgcactaaatctccacttgtttttaacagtctccagttaaatatgtggataattaactagtccacaatatagtctgagttaggaattgtgtcactagattacctttgaaatctttccaattctaaagctccctggttttgtaagagtaagctcaggttaatccaagcatcacaaatctacgtctctccccttcacgcggtcagctgctttactccaggcgggaggaggtgtgctgtggtacaccagtccctgcacaacaaaagcagttacctaaaagtaaagcgtggagaggaagaagcacaggcagctcagcacccagtgccttgcacaaattatacaggaatcacctgaactgagaggcagcaccagccagtgaagcaagctttgttttaggacttgtaagaaatctaagacacccaaacccctctttgtccctaagtagccctagcctggtaagaggtcacctttcctatctgcaggatggcaagttggcctagaatctctaaggtcccttccagctctgacattcagatgcgcagaactgagggt

SEQ ID NO: 50306 - DNA, 347 bp, Homo sapiens
ctgacaagaccttcatgggagaaaatgtaaaattatatcagaagacattaaactaacatctaaatagacagagctttgtcatgttcatggttaagaaggctcaattatttttaaaaatgtcaattcttcttgaattggtatataaattcaaagtaattcccataaaaacgccatgctttttttctgaaacttgataagatgattttaaaatttatatggaaaagagaaatgacaggaacaacaagtgggaggatttaacctgctagatcccttgccgtaaagctgtagtaacgaagagcagtgtggtgtagatgcaggggctgaggtgggtcagcgcgtaagtggga

SEQ ID NO: 50307 - DNA, 343 bp, Homo sapiens
ctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagctt

SEQ ID NO: 50308 - DNA, 248 bp, Homo sapiens
catgatgtcattccaagagctggttccggtccctgaggcccatgacccaaaaggcaccccagccagacaccttgtgatgccatgagcaagggtgactttatttaagattgaacagagccacactgttgacagtacatatcacgcttgtcacgtaagcttacgataacccatgagggtaggcattgtcactccacttatgcaggaggaagcagagacccaacactggggctgaactagatctgcctccc

SEQ ID NO: 50309 - DNA, 365 bp, Homo sapiens
tctgggttcaaattctagcgatcccacttatctatagtgtgacgtgggcaagtgactgcctccctgagcccatttcctcttccacatgtgaaaggatgtcacatggacaatcagctttggctctaacaaacctagagcatccgtcagtggcttaaacaagatagatgtttatttcttagccacagaaaagccaagaggtaaccagttagctcggggacctaagccgcttctgttttgttctcctgggcacagcttctcttcctagtgttgcatcgaggtctaagaggctctggccatcatgtcttcattctatccagcagggaggaaaaagggaggaaaaggggcaaagcgctcatgccatttgt

SEQ ID NO: 50310 - DNA, 474 bp, Homo sapiens
tctttcagagttctaagggcagggaaatttccaactcctgtctctattctcactttgctaatcacagcaatgatgacaaataagcaccccagcgttttcctaacttgaaatgaaattgaaatctgtacacacggttaaaatccagacctagaagtgatgctgtgattaaaagcatgggctctggatagagagagatctggattcaaacccctgcttatctatttttatctataaacttagggcaagtgacatagattctctaagccaagtgttctcatctgtaacaaatagatttcgtagggtttttgtgatgataaatgagataatgtgatacgtgctcaataaatgttaactatgattagtaagaagagctccaggggatgtcttcctttgagtcatgcagctttgagaatgctgggatagctctaggtcaggggaaattgcataggattttaatacatcttgggatttaaa

SEQ ID NO: 50311 - DNA, 1037 bp, Homo sapiens
ggtacagatatttatttatttattgagatatggtctcactatgtggcttaggctgtagtgcagtgaatgttcagaggagcaattatagccagtacagcctcaaattcctgggcttaagcaatcctctttcctcagggcctctgaggaactgagattacaggcgtgccagcacaccaggctcatcagggatttcttatatactcctactcaacccctacatgcataaactcccccattatcaatatttcctaccaaagtgatacaatagatgagcgtacattgacatctcattatcacccaaagttcatagtttacactggggttcactggtggtgttgcataatctatgggtttggacatacgtataatgacatggaagctacatgatattttcctacagggtagtttcactgccctaaaatattctgtgaatcgtctctttatgcccctcacccaacccccaggatcccagtgttttctttttgagtttagctgctgatgtttgtcggtttatcaggcactcaaaaaactgcactctctattccctttgctctttttaagggggcatccttatttcctagacagatttgtgactgtgtagatgctgggaacatgttttgctttggagtggggaggggggaaatcttgtaaagatttctctttgtcacatttttgatttgtgaattctcagaggctggacctgggcttcctggaaggtaatgcagatgtgacgtcacaatttcctgtcccgtgctcttgggattggtgtgagaatagtttatcagaatgggctgaccttctgcagattccactgctgaactaattttatagatgaggaagctgaggcccagaaaggcccagaaaagctgaagctcttgggattggtgtgagaacagtttatcagaatgggcaaaacctctggagactccactgctgagctaattttacagatgaggaagctgaagcccagaaaagtaaccactgggacatgccgattaggagcagatatcttcaaaaaaataacttgtctttaaaga

SEQ ID NO: 50312 - DNA, 204 bp, Homo sapiens
acgcggaggaagcccccaccgaggccccccggcaccgcgcctgctgccgggttgcgctccgtgcacctcttgcggattccctataaggagcccctgctggtgcaccagaactaccgggggccatctgcccaactgccccagactctggcagtggggcccccgatggcagtgggcacctccccgtgaaacctgccaagctggacg

SEQ ID NO: 50313 - DNA, 2703 bp, Homo sapiens
tgacatatgttggttcaacttgtatatactattttgtaaactgtttttcccaattaacaatatacacagatgtcttcattttacacacccctctcctacacaccctcagacaaaaggcaaacctattcaagtttttgatttttgaaaatgtttcaatcagggaagctctgggtacatttcatgaagagaagtgatgaagatatccctctgacataacagaaagtggctgtttagctaggaaaatcatcaaataagtaagtagaaatgcatgcagaaacagaatgagtcaatcccaattaatgtttctgtgtttcctaaaagaaaataaacaccgcacatttgtctttagacagcttagtgtgcaccatggttccagtgtttttgctggaagtgtaaagttgttagcacaggcatatttctcagttagcagaaaacagctgctactggaattagtacccagaaatgaagttatttcctcccatcatcttactgaattgctctgctttacaaacaagaagtgaacattaattacttggaaaataggcctgacccagccaggatgaggctgacgcgtggaaagaggtaaaaataaaatgacaaagctctcttcacttcctatgctagtgtctgaaaacagagctgctcagaccattatggtcatttcaaagttttcattcaataaatagttttttagacacctactgtgccctacagggacatatatttttggcatacaatcaataactacaaccgtggtaagaaattaaggtacatgctgaacacttaccactgcagagagatcttatcgccagaattttagcaatcaagactattggcttttggccttccaaacagataaaaggtaacaattttttgaaaaactgagtacctaaactgccagatacattatatgaattctattatttaatttttgcaatgactctatgagttaggtactgttcccaaacccatttcataaatgaggtaaccaaggatcaggaaggtgaagtaaactaacctatgttttacaaaaaataaaaggcaaagctgaattctgaacaaatctcttctcacttatcacactgtttccctgtcaagccaagccctaggaaaacttacaaagtcagtcaaaatatagctttactgttttgccttttctggttcttactgcccttaaatggccagttccctcatcttccctccagatgcacgttccaaattccaaacttattactctgtggccacaactaaagctctcacatcccctgtgtgatccttcagacagggaaaaagataagtagtgattatctaactgaagtaattcattctagggtagatggctgaattcccttaaccctcccaaccattttactaatttttttgtcaaacatttatcactgtatctcccaatcattttaataaagggactcatttccagttggcagaatgtatgtatatgtgagaaagaaatatttgaaaatggagatctccaagaaaatgttttttattgcagcaaggaatcggttaccttacttttgagaggatgttccactcaaatcaacattaaacaatcaatgctacaatgcaaatagtaaaaaaagcttactggggctcctgctaagacgtggcgctgaggttactgcacccaatgaatgtgctagatagtcatccacgcaggcatttctgcaaatatgtattaagtacctactatttgatagtatatagagtttgggccaatacaggaagaatttttaaattcacatttcctattaatttcagtagccactttacgtcatgctatccaacaagggtacataaaactaaaaccttcagacttggaatatttgtataaaatgcattaatttgatagtaaaacatctgagctatggcatatgtttttttcttttttttagacggagtctcgctctgttgcccagactggagtacagtggtgtgatcttggcttactgcaacctccacctcctgggttcagacgattcttgtgcctcagccttccgagtagctgagattacaggcatgagccatcacatctggctaattttttgtattattagtagaggtaggttttcaccatgttggccaggctgatcttgaactccttacctcaggtgatccacccacctcggcctcccaaagtgctggggttacaggcatgagccacacacccaggcaaaagattcttgatgtatctaaaatggtatactgcatgacaacattttggccaaagataagaccacatgtattttgggagtcccataatattataacagaactcagggtgatgggtgtagcaaactaccatgacacatgtatacctgtgtaacaaacctgcacattgtgcacatgtatcccataacttaaagcattaaaaaaaaaaaaagattataacggaactgaaggattcctatcacctagtgacatcttggtgatcctgacctggcgtaggcctaggctattgtatgtggttgtatcttagttttgcacaaaaaaaagttttattcagtgatgttatcatggcccactgcatcctcagcctcctgggttcacgtgatcctctcccttcaatctcctgagtagctgggactattaagcacatgcccaccctgcccagctaattttttattttttgtagagacagggtttctccatgttgtccaagctggtctggaactcctgagctga

SEQ ID NO: 50314 - DNA, 696 bp, Homo sapiens
tgctcatgtgatcctataccccagccttctgaatagctagaactattggcacacgcatccacaccccagctaagtttttaaattttttggaggccaggctgatcttgaactccttacctcaggtgatccacccacctcggcctcccaaagtgctggggttacaggcatgagccacacacccaggcaaaagattcttgatgtatctaaaatggtatactgcatgacaacattttggccaaagataagaccacatgtattttgggagtcccataatattataacagaactcagggtgatgggtgtagcaaactaccatgacacatgtatacctgtgtaacaaacctgcacattgtgcacatgtatcccataacttaaagcattaaaaaaaaaaaaagattataacggaactgaaggattcctatcacctagtgacatcttggtgatcctgacctggcgtaggcctaggctattgtatgtggttgtatcttagttttgcacaaaaaaaagttttattcagtgatgttatcatggcccactgcatcctcagcctcctgggttcacgtgatcctctcccttcaatctcctgagtagctgggactattaagcacatgcccaccctgcccagctaattttttattttttgtagagacagggtttctccatgttgtccaagctggtctggaactcctgagctga

SEQ ID NO: 50315 - DNA, 469 bp, Homo sapiens
gggtgacatcgaattgtgctctcgagctcacaaagccctttgttgagctccattgcatttgttcttcacctgcaccctgcattatgttgccagggttttagcgtcaactagcttacccagttacccgacttggaagtggcagagatggactcaactgaagcctgctaactctcattttagcccctttctaccacatgctgccttttataacatagaccccagcatgcctgggtggagatctgctggagtttatgagcctgggtaccctggggaaaagatgtggatgggattgagtgaatgggaggtgcaagtagtttctctctctggggcagcagccacttgcttgggacaccacaaacacttccctggcagctgagcaccaggttgattaggagcataacattttccgggggaaaatggggaaaacttgcaaaatgcagtttgtttttttccagaggtccatgagaat

SEQ ID NO: 50316 - DNA, 1002 bp, Homo sapiens
ttttctacccgttaatgaaccaattatattaaatcctctaattgctgacacatgttgaattgaacagacactttaacaacctaccagcagcacagagtattcccagttttaccattttccatttagctatagtgtccttttaaggattctaggcaacagtgaaccttatttaaaaagcaaaattgtgctataacaagtgcaaaaggaaagtttgtgttcctaccgtgctttaaagtattgatggtagcaagagaaagcgcagtggtgtttttgctcatagaaattctggaaattaggtgcctgaagtcttacactcattttttaaaagtatagcatctgcttccagttttcagtgactccattgatgatgcatgcggtttggccgtatcatactgagctttaaacacaagatttataaacatggtatgtagtgcatcttttgcaaacaggttggcagcggtactgtgtgacttggtcttttgtggcttttttgagaaaaatgaaacactttgcatgtatagttttttctcccaactacttgtgagtagttcctggttataaaacgttatgaaggtagcacataacccttttctagaatgaagaggcttttgagctaccagtgtaaggggataggtagaaatagagatgaaaggcactaagatgtcctactctttaagagcattgaacgccagttgtgccatttattcaaagtcatctttgaacttatgttaaaatggggtaaaaacaggtaactacttcaggccgggctcatgcttgtaatcccagtgctttgggaggccaaggcaggtggttcacctgacctgaggtcaggagaccagcctgggcaacatggcgaaaccccatctctactaaaagtacaaaaagtagcctagcgtggtggcgcacccctgtaatcccagctactcggggaggtggaggttgcagtgagccgagatcacatgactgaattccagcctggatgacagagggagactctgtctc

SEQ ID NO: 50317 - DNA, 272 bp, Homo sapiens
catgtatgttgttgtttcatacatttacaatatttttaaaatttaaaccagtagtctaatgtaataagaactatttcaccatgaaagataaagagtgtaataattcctgtcaaaagtccaatgtacattgtctaggtaagcagaatccagatagttcacctgaaaaatagtaaaatgtccaaacagcttcataaataaatagactatgtttaatcttaaaaaactgctaatatacgtatttgatattaagaattttaaaattaatttcactg

SEQ ID NO: 50318 - DNA, 324 bp, Homo sapiens
atgtgtttggtcttcgaccccttttcctgacatacaactctaaaaatccttagaatctccacagtgatgtcttttgtattttaatgaccgactgatgggtggcagcccgtagatagctccaagatggggctggtcaccagaaagaccaaggcattactagaagattggaaccttcagcccacccccaccctccagggaggggagaacaggtgaaggttaagttgatcaccagtggccaatgatgtaatcaattatgaccatataatgaagtttccataaaaacccaaaggactggggtccaagagcttctggatagctaaacac

SEQ ID NO: 50319 - DNA, 2087 bp, Homo sapiens
tcactgcaacctctgcctcccgggttcaagggattctcctgcctcagcctcccgagtagctgggattacaggcgcctgccaccacgcccggctaatttttgtgattttttttccagcagagatggggtttcaccatgttgctcaggttggtctcgaactcctgacctcagatgatccacccgcctcggcctcccaaagtgctgggattacaggcgtgagccaccgcgcctggcctgtttattctcttaagagagaaaatgaggggattaatggactgtagttctggacaaggtggaaaactcttaaagtggaagtactggggcaagtgctctgacagggtaggatggtgcagtcagtcccttcacccagaaatcagtagaatgttagcagttcagactcaaaccttgtgaaaaacaggtggtggaaaggaaatccctcacagcaactggcaccataatcaagacaatgtttacaggataaatggagttacctgctttcagccccaggtcgtagctattgtctgccctgctgatatgtgataataatttgtgatcctgttgtcttaaaatggggtcactcatctccagtagaattaagtccacagtgaagttgtccccccatccccaaagagataaacatatatgaatgaactcacgtgataacaactactgctgcctgggatcatgagagacctgaactgaactgataggaagtgaaaggtggctgagataatgagaatagacccatctgcagaggatcataaaaccagcaaagacaagatcttgtctaagatgccttcacaagctttgtccatgagaactcttaaggatttcaccagacctgttggctgctgctgtgatctctgcccaagaggagcctctgaccaacatccaaagggcttctggacccactggactcctctggaggtaccttggtctcccgatccatggctgtggttttttactccctttatcactgcctgtgtgtagaatgataattgcacaattgatagtgtgaagacctcttgataaatggtaaatctgagcatatgtatttggctgacatgtcattgtgaaacctcacagcttcagtcagtgtctctccaaggactaaacaatggaagactgtagaagatgctattcattaagatatcgcaagaatatggaagactattattcgcttctcatgggacaggacttttcagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttccattctcttagcttaagaaaagatcattacaaactttttgtaagtttttcatatatgcttgcaaagggtcgtaaaactttattgtgattattcttgctttaagctgaaacatccctaatctttctttagagattgtggcatagcatgttagtttcttttccatatccaattgttgtctgtaatgaatacagaaatacgggcactattttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattctttttccttccactgtggtttcccgcatttcaacatatcacctatttttgtcctcaaaggttacttaaattttttccacagaattaaattaaatatgaatcatccctcctctgatttttgaaatgaccctttgcttcctatgataatgattcttctggtccgttttgtagttatatgttagagtttgtaaatagtcacacattttgcaactgcatgtaattttcttattattttttcctcttcctctaaaactgctgttatttcttttaactttttgtgggaaaaattaaacccatctttcactttgttgatatacttatttataatt

SEQ ID NO: 50320 - DNA, 2069 bp, Homo sapiens
cttatttataattgaaccccttgatttttgctcgaattgcttttcaagttactcacttttagggaagacattatttgggttttgtttagtgtatcaggctttttttagttagttgtatcaagaagtgtagacttttctaaacataaaatcctttttcccccagtagttttttttttttttttttttaaagtctggcgtgagccaccgcgcctggcctgtttattctcttaagagagaaaatgaggggattaatggactgtagttctggacaaggtggaaaactcttaaagtggaagtactggggcaagtgctctgacagggtaggatggtgcagtcagtcccttcacccagaaatcagtagaatgttagcagttcagactcaaaccttgtgaaaaacaggtggtggaaaggaaatccctcacagcaactggcaccataatcaagacaatgtttacaggataaatggagttacctgctttcagccccaggtcgtagctattgtctgccctgctgatatgtgataataatttgtgatcctgttgtcttaaaatggggtcactcatctccagtagaattaagtccacagtgaagttgtccccccatccccaaagagataaacatatatgaatgaactcacgtgataacaactactgctgcctgggatcatgagagacctgaactgaactgataggaagtgaaaggtggctgagataatgagaatagacccatctgcagaggatcataaaaccagcaaagacaagatcttgtctaagatgccttcacaagctttgtccatgagaactcttaaggatttcaccagacctgttggctgctgctgtgatctctgcccaagaggagcctctgaccaacatccaaagggcttctggacccactggactcctctggaggtaccttggtctcccgatccatggctgtggttttttactccctttatcactgcctgtgtgtagaatgataattgcacaattgatagtgtgaagacctcttgataaatggtaaatctgagcatatgtatttggctgacatgtcattgtgaaacctcacagcttcagtcagtgtctctccaaggactaaacaatggaagactgtagaagatgctattcattaagatatcgcaagaatatggaagactattattcgcttctcatgggacaggacttttcagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttccattctcttagcttaagaaaagatcattacaaactttttgtaagtttttcatatatgcttgcaaagggtcgtaaaactttattgtgattattcttgctttaagctgaaacatccctaatctttctttagagattgtggcatagcatgttagtttcttttccatatccaattgttgtctgtaatgaatacagaaatacgggcactattttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattctttttccttccactgtggtttcccgcatttcaacatatcacctatttttgtcctcaaaggttacttaaattttttccacagaattaaattaaatatgaatcatccctcctctgatttttgaaatgaccctttgcttcctatgataatgattcttctggtccgttttgtagttatatgttagagtttgtaaatagtcacacattttgcaactgcatgtaattttcttattattttttcctcttcctctaaaactgctgttatttcttttaactttttgtgggaaaaattaaacccatctttcactttgttgatatacttatttataatt

SEQ ID NO: 50321 - DNA, 1534 bp, Homo sapiens
cttatttataattgaaccccttgatttttgctcgaattgcttttcaagttactcacttttagggaagacattatttgggttttgtttagtgtatcaggctttttttagttagttgtatcaagaagtgtagacttttctaaacataaaatcctttttcccccagtagttttttttttttttttttttaaagtctggcgtgagccaccgcgcctggcctgtttattctcttaagagagaaaatgaggggattaatggactgtagttctggacaaggtggaaaactcttaaagtggaagtactggggcaagtgctctgacagggtaggatggtgcagtcagtcccttcacccagaaatcagtagaatgttagcagttcagactcaaaccttgtgaaaaacaggtggttttttactccctttatcactgcctgtgtgtagaatgataattgcacaattgatagtgtgaagacctcttgataaatggtaaatctgagcatatgtatttggctgacatgtcattgtgaaacctcacagcttcagtcagtgtctctccaaggactaaacaatggaagactgtagaagatgctattcattaagatatcgcaagaatatggaagactattattcgcttctcatgggacaggacttttcagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttccattctcttagcttaagaaaagatcattacaaactttttgtaagtttttcatatatgcttgcaaagggtcgtaaaactttattgtgattattcttgctttaagctgaaacatccctaatctttctttagagattgtggcatagcatgttagtttcttttccatatccaattgttgtctgtaatgaatacagaaatacgggcactattttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattctttttccttccactgtggtttcccgcatttcaacatatcacctatttttgtcctcaaaggttacttaaattttttccacagaattaaattaaatatgaatcatccctcctctgatttttgaaatgaccctttgcttcctatgataatgattcttctggtccgttttgtagttatatgttagagtttgtaaatagtcacacattttgcaactgcatgtaattttcttattattttttcctcttcctctaaaactgctgttatttcttttaactttttgtgggaaaaattaaacccatctttcactttgttgatatacttatttataatt

SEQ ID NO: 50322 - DNA, 2719 bp, Homo sapiens
  misc_feature (1002)..(1002): n is a, c, g, or t
  misc_feature (1360)..(1360): n is a, c, g, or t
agatagcatgtgtaattaatttttaatgcagtgctggatgcagcgctttcaagcagttagtggatgtgaagaagcagcactggccaaggacatcagagacctcagagcaaggcagccccgttctcctttaaagggactcggaaagtggcagaggaggcttgcattgccctctgtgtggagcggactggcccagaaatgggttcttctcgggtgacctgaggtcaagtcagtctataacaatctaagaccagggatcccaagagatcatctcctccaacctcttcattatataaatggggaaaccaaggcagagagtggggatgaagccatgacacatgggtggcagagctgactcatacctgggtctgcccactaggccatactacctctcttgagtttttattgaaaaccagaaaaggaagttcgtcgcccagtggaagccacttaaagattgatttctgcctgaccatgaggcttggtgtgaaccctgcaatgagattggtagcaggtagagctctgatgttgaggagccccacgttgggtgccttggacttcagctctgctatctgcagtgggagcccaccagacacatcctgggtttgagactctggggttgtgctttgacagctggctgccctgtccctgtggggctctgtggcatggatgtgtgtttgaagttaaatgtcattgtggacccgtgttagactgcaggcattgtgggaagctctcgagatggggccatcctcggtccttcccttgcagtgaatgggagtgagtatgtgatcccaggctagccacttacttcctctctccaatcttcagtgtccccacctgtaaaatggggacactgaagtacttgcttaccatccctctactggcaggtcccatgaacagctaccatctgggcgtggccacagcccatgaccagcacctgggggaatcagagggaaaaggccggtgggaagggaaggagggagaaagctgagatgccggaaagccttntgagactctggccttgggtaatcggcaccccagtgacgacttagctcttggaaagccacttgcctgggagagtttcttagtgtgaatgaaggcagaggaagggccaacatcatcagtgttcctggggcttgccactgtttgctaaagggccggctcagtcctaggcatgacatctcatcgttgtaacgctcccaagaagaggcactcccccacccttttgcttatgaggatattggggctcagagaggccacacaacccaccaggggtcacacagcacacaaatagcagaacttggacagagagtctcaaaacagagattcagactcaggtctggccagcctcccagctgtacttggngctctcccgtctggcttcccactgggctgtagtggacaacagagaaggagctgctggtagaaaaccaaatcaaactctgatatggtacctgggagggtcctgaaggtcttccttcatgcactggtcatccttgtgccagaccctgggctggactgagggatccggaaatgggcatgacggggtccttgccctagaggaactcaccgtggtgggggtgcccatggagggccttctcactcagtggatgtgaaatgcatgtccccatggcgcctttctctgtttgaaaaaaatgaatcaattggctgctgctcgggtgctccctcacttattgccatggtgcagctcaagagcagatctcaggatggagaggtgtcccacctgaggacagcttgtccttgtggtcgcattgctgagaggtggggggtaccttctgtgaggatttttacctgaatgaagcacaagtggtgcctgactgcattggaatccacgtgattattggcgtgtttttgactctcattttatccagtggtgcattgggcccatggctggtccataaccgcatgttatgtggaagaagcgagagagtaatgggttttccatgaaaggtggtgctgtttctggaaatggggcatacatatgctcatcctcatggagcagcgccgtattaaacagaattgtgtgaattgaaggtcacctggaccactcttggaaaatgctcccgacccccatggggttccttccagagaatttgtgttctctgtacctgagatcaaatgtgtgtctaagcaattctggcccctggctcccaccaccctaccctctccacaaaataatagacattaggggaggtaagggaacagaagaggtctctttgcagatattatatttttaaaaaatggttctatgtaataagcagcagctaaggagacagaaagacagtagatgaagagagtgccaatatcttccatggggaaaaatgaatgaactgaaagagaatattatttttctagaatacagaaagctgtcctctcacagatcagctggaattccaaggtggattatggacttcttctaactcccattgatagtgcttcttaccaggtgaagggaagggctactttttcctaaaggagaaaaaagctttcagacaaagctcgtaccaacccctgaactgcaaatttgctcaagtgaccgtgcatacttatattcctaatttaaatgattatttatgtcaaacgctcattgtgaaacttgaaaatgttgtattacattacatcaaataaagtttacttgtagcagacagaaagagagaaagagaaagaaagaaaggaaagaaaggaaggaaagaaggaaagaaag

SEQ ID NO: 50323 - DNA, 4039 bp, Homo sapiens
cgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaagataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattagaatgaaattcaccagaattagtactcccaaaaaatctaagaaaaaatctaacaaaagatctgagaaatctgaagcaactgatggaggttttacttctcagattagaaaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagattctgttataataatagattcaagtcctactgctttaaagcatccagagaaaaatcagaagaaacttcagtgtttgaatgatgtgctaggaaaaaaacttaacacatccactaaaaatgtacctggaaaaatgaaagtcgctcctttatttcttgtcagaaaagcacaaaaagcagctgatcctgtccctagttttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatgggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtgttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaagattctggaactgaagacatgctttggacagaaaagtatcaacctcagactgccagtgaacttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaagtaagtaaactattttccttaagccataatgttttgaaaaaaataaaatctaagaaagtaatgtt

SEQ ID NO: 50324 - DNA, 1732 bp, Homo sapiens
agacgacggctccctttaatctaggaaaatgaaattcaccagaattagtactcccaaaaaatctaagaaaaaatctaacaaaagatctgagaaatctgaagcaactgatggaggttttacttctcagattagaaaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagattctgttataataatagattcaagtcctactgctttaaagcatccagagaaaaatcagaagaaacttcagtgtttgaatgatgtgctaggaaaaaaacttaacacatccactaaaaatgtacctggaaaaatgaaagtcgctcctttatttcttgtcagaaaagcacaaaaagcagctgatcctgtccctagttttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatgggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtgttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaagattctggaactgaagacatgctttggacagaaaagtatcaacctcagactgccagtgaacttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaagtaagtaaactattttccttaagccataatgttttgaaaaaaataaaatctaagaaagtaatgtt

SEQ ID NO: 50325 - DNA, 155 bp, Homo sapiens
aatgtgatttgtgattgtatttttttctattattaaatataaaatattttcttgtgatgtaaattaatgtttcaattttttgtttaggcaagcaatacttcaaaaaacatatcaaaagcaaaacaattgattgaaaaagcaaaagctttacacat

SEQ ID NO: 50326 - DNA, 583 bp, Homo sapiens
agttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattaggtaaggtttgtttttgttctaacgttctagtattctgcatgtattattagctggggacaaaaatgcttcaagtattggagggtatttttttttctagaacacagctgtttaaaagaaaaagaacaggatttcttttttttttttctttgagatggagtcttgctgtgtcgcccaggctggagtgcagtggggcaatctcggctcactgcaacctccacctcccaggttcaagcaattctcctgccttagcctcccaagtagctgggactacaggcacccgccaccacgcccagctaatttttgtatttttagtagacat

SEQ ID NO: 50327 - DNA, 1786 bp, Homo sapiens
cgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggag

SEQ ID NO: 50328 - DNA, 1248 bp, Homo sapiens
cgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctcccaaagtgctgggattacaggcatgagccaccgtgcccagccccattcagtatatatagcttttccaaagtatgctattgatttattcatttatatagctttatacaggatgagtatccctaatccaaaaatctgaaatttgaaatgctccaaaatccaaaacattttgagtgctgacatggtgccataagtggaaaattccatacctggggccaggcaccatggctcatccctataatcccagcactttgagaggccgaggtgggagcattgcttgagcctaggagtttgaggccaggctgggcaacacagggagaccacacctttacc

SEQ ID NO: 50329 - DNA, 1082 bp, Homo sapiens
ggaaaagatggggacaccaaaccaggacagtggctggagtgtgggggtgagaagtgggtataaagtggagaggagatgagcttggtctctgctctggtctcagcctttatgtactgtcttggtgggatgaccgtggttgggtcctgcctccaagggtatcccagagggttctagaaactcccacatggacaggcacttgaaggatagtgctggtgattgggcaggtgcctggatggaggtgaggcctaaagcacacccggggacagaaggcagcacccacacgggagcccagcttcgtgccagggactgtattttaggtgctggatcttgtttaaatcttccggctggctatgattatcctctaagctggggaaggaagaaaagcattccagtactatacctctgtttgggttaaaggaggggaaagtattttaaataaaacctattagagttaaaaggatgagtagcaataaaaatatctttgaatctctgatggttctattgtagtcaaaagttttagataaattgtgaagaatctctaatcatgctatgtggagtttttctcttttaaaaaatacaagttattgtatatacttaaggtatataacgcgatgttatgaatacatttagatagtaaaaaggttactatagtgcagcaaatgaacatattcatcatctcagctggcacaaaagtaattgcaatttttgccattactttcaatgacgaaaactgcaatacttttgcactgcactaataaaatctgctcatttagcatgaatcccaaaatacagtacaacttattccctatagtcctcatgttgcacattagtgctcttttttatttttaaatttttatttttgttatttttaatatagagagagacagggtctcacgacattgtccaggttggtcttgaactctggggctcaagtgatcctccctcctcagcctcccaaagtgctgggattacaggcacaagctctctacacttgttcattccacgtatctgctaccttgcaccctccatatcctcattcgtggattcaaccaaccacagatcagaaatattaaaaaaaaata

SEQ ID NO: 50330 - DNA, 483 bp, Homo sapiens
atctacaatttataaaaagtttgtgttatattctaaattggtgagttggttatttagatcctaaaattgattcttcattcagaacaaaaaaattataaaataacggacttgtttccatggtagccagaataagtaaggttgttgacaaaagctaagtgtctgtttcacagagataactttcttaatggtggaaagattctgggtgttaccatattgctaccaggtagctctgtgtcccctgtgaaatgtggtactgtttggtgtggaggtgagaggaactcaagagttaattgttgcttatagtagatcacattattcaaaaacagttgcttcccttctttactggcttctccctacaggacctcctatttgtgggaggagtacttccttgttcctgtggacatcaggaatggccatggaacttgatttggccactggaagatgagtagaagtgattatttgtcatgtctaagctgaagcctt

SEQ ID NO: 50331 - DNA, 448 bp, Homo sapiens
cctctgaaatggcaatgcaaaatatattcgtgtgatttgttgatctaacacgcaggatgctaagtgctaggcattgttgaaagtgccttaaatgttaactgatttaatgcttttggcagctgcttgaggtaggcactatcactatcctctccattttatagatgatgagcctgaggtgcagagagatcccgcagctggtaagtggcagagccaggcaagtctggtgccagggtttcagcgactatcccaagctctgcttagtcttcctgtacaaagggaacgataactagtagtctccagtgatgtttttgttccagatagtacaggatcaaagtgatattttggagacagatccttccattttcaaaagcatctgccttaaagacatttgtctagaaatatttatatgattgtatcacacttaatatgtgcttggcttagagcaggc

SEQ ID NO: 50332 - DNA, 175 bp, Homo sapiens
aggataaagggtgtagccatagatgggtggtggtgaagatctctgagatgaggagctcaaggaattgagaggccagggtgtggacatcaggtaatattataacaccattattagatggagagagctgctgagaactactgccagagtgagttgagtagagtgaactggaggggta

SEQ ID NO: 50333 - DNA, 421 bp, Homo sapiens
aaaaaaaaaaaaaaaaaaggcttaatcttatctgtgaggcttttgggcccacaatttaattacacattggatgcagaatatgctatccattcactggcactccaaatttcctggactcctatttccccaaatgtatattttattaagagagagataaaaagtatgaaacaattcaactgtcattgaaccacgtcatatttatttggtatccagactcttaaaacataacattctagccgggcgcagtggctcacgcctgtaatcccagcactttgggaggctgaggcgggcggatcacgaggtcaggagatcgagaccatcctggctaacacggtgaaactctgtctctaccaaaaatacaaaaaattagctgggcgtggtggcgggcgcctgtagtcccagctactcgggaggctgaggc

SEQ ID NO: 50334 - DNA, 702 bp, Homo sapiens
agaggatccttaatctgtgtcattgcgaaggcacctgccttttatagattgtgtagtagctctgacacattactttctgagggtgaagaaaatcaaaaaccaaagaaatcagacacaaaagttgattcatctcctagaagaaagcattcttcctcatcgaattctcaaggcagcatccacaagagtaaggaagatgtaacagttagcccatctcaagagataaatgctccaccagatgaaaataaaagaacaccttctccaggtccagttgaaagcaagttcttggaaagggcaggagatgcctctgccccaagatttaacactgaacagatccaataccgagattcaagggagattaatgcagttgttacccctgaaagaagacctacttcttctccaaggccaacgtccagtgagcttctacgatctcattcaactgatcggcgtgtttacagtcgttttgagccgttttgtaagattgagagctctattcagccaacaagcaacatgccaaataccagtataaatcgcccagaaataaaatctgcgactatgggcaacagttatggcaggtctagtccattgcttaattacaacactggtgtttatcgctcatatcaacccaatgagaacaagtttcgaggatttatgcaaaagtttggaaactttatacacaaaaataaatagctattaaaatgcaaa

SEQ ID NO: 50335 - DNA, 741 bp, Homo sapiens
gggtctcagaagttaaggtcattacttagccttaccccagataagaaagaaaatctatccaaaaataaagcacctgccttttatagattgtgtagtagctctgacacattactttctgagggtgaagaaaatcaaaaaccaaagaaatcagacacaaaagttgattcatctcctagaagaaagcattcttcctcatcgaattctcaaggcagcatccacaagagtaaggaagatgtaacagttagcccatctcaagagataaatgctccaccagatgaaaataaaagaacaccttctccaggtccagttgaaagcaagttcttggaaagggcaggagatgcctctgccccaagatttaacactgaacagatccaataccgagattcaagggagattaatgcagttgttacccctgaaagaagacctacttcttctccaaggccaacgtccagtgagcttctacgatctcattcaactgatcggcgtgtttacagtcgttttgagccgttttgtaagattgagagctctattcagccaacaagcaacatgccaaataccagtataaatcgcccagaaataaaatctgcgactatgggcaacagttatggcaggtctagtccattgcttaattacaacactggtgtttatcgctcatatcaacccaatgagaacaagtttcgaggatttatgcaaaagtttggaaactttatacacaaaaataaatagctattaaaatgcaaa

SEQ ID NO: 50336 - DNA, 1280 bp, Homo sapiens
ccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgttacagctgaaataatttttagtattttctttagtgcaggtctgctgaagataaattctctcagttcttgtttgtctaaaatatctttgggccaggcacgtttgttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtg

SEQ ID NO: 50337 - DNA, 3088 bp, Homo sapiens
ggcacgagcggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgta

SEQ ID NO: 50338 - DNA, 3132 bp, Homo sapiens
ggcacgagcggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtaaaaaaaaacaaaaaacacaacacacacaaaaaacacaaaacaac

SEQ ID NO: 50339 - DNA, 1972 bp, Homo sapiens
tttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgta

SEQ ID NO: 50340 - DNA, 474 bp, Homo sapiens
tttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccgatggattttctcaaaccaactggtgagtaaatgatttttaaaatatcctgcttatcttaagttagaaatagagcctctagaacgtggctttttgtgtgtaggcaaaggcttggggaggtgctgggcttcacgttggttctaggtttcctctgttggaagtttggtgaatttttctgttgtggctgggttttttgctgtttttgcaaagacgttcccttgatatgctttacattttgttcctttttcatgtatttgtgctgtgtagccggtgggctca

SEQ ID NO: 50341 - DNA, 802 bp, Homo sapiens
tttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtgtacaaccgcagcagttaccccatcttcatcaagtccggcacactgggggggctttcagattcccaactttttttggagcctgggggatcggtcacactggtgcgtggtggcatactgggaggagaaaaac

SEQ ID NO: 50342 - DNA, 2286 bp, Homo sapiens
tagtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgta

SEQ ID NO: 50343 - DNA, 423 bp, Homo sapiens
gtgcaaagacttaggatacccagaatttgttttgaaaatgaagaataaggttggaacttttacactctctaatttcaagatttattataaaatcttcaagaatgaaagtattgtggtcttaccataataataaacatatagatcaatggagcagaatatagccctcaaatagacccacgttatacggtcaattgttttttagtcaacaaatgatgttaaaacaactggatattggtatgggaaaaaatgaaccttgtctacttgacctttccctcataaaatacataaaaactaatttgaagtggctcataggcctaaatagaaaagctaaaactatgaaagttttaaaagtaaacttagcacaagataatatcaactttggttaggcaaggatttcttagaacacaaaaaagtactaagtgt

SEQ ID NO: 50344 - DNA, 904 bp, Homo sapiens
tttcaacaaccctaatactttactagagaaggaaattaaggcttaaaaagcttaactttcacaatgtcatccagtgatgaggtgatgaagatgtgagacctaagtccaggttctgttcactgcacaacgctccatttacctgtataatgctgagcaccaaagaaagcaatccacaagggaatcattttgcatttaagccctccctgcaagttaggatcagagggaaggaaaaagctgactgtcattttgtttccctcacaaaggtacagactagcctagaaacggcactctttatcacttaataatcctgaaaaaatgttcccagatttcaaggctggatacatatctgcttactactagaggtcatgttccaattagaacaaaagccttgtgatgtgtaacatttttggggaaaagccttgttctgctatcattcaatagctacttgatcaaaaatataaatgtcagattgctcccagagattctgccaatagctcttccttctaatattcatcactgccaaatagctggcttataatgcaatactaatatgtaactggatatatatggagggaagagttactcattagtacagcaggaagtaaggcatgcggggagtttgtcccacactatgggaagagcaggattgatgagagccaagttgagatggtggctgacttcactgtctctcatctagacttctgctaatgtcaatgcctaatatgtaccaaccaggcaacagataccttgttatcccccacaggcatcaaggcaggcatcaatctctcactttatagctaagaaggatgaggggacaaaaattaaaaagtcatgttctattcactgctatgtaaatcttgccttaagatcccacagcctggaaataaaagaactctaattcaaa

SEQ ID NO: 50345 - DNA, 389 bp, Homo sapiens
attctcctgcctaaacctcccaagtagctgggattacaagcatgtctgaccacgcccagctaattttgtatttttagtagagacggggtttctccgtgttgggcaggctggtctcgaattccagacctcaggtgatccgcccgcctcagcctcccaaagtgctgggattacaggtgtgagacaccccgtctggccaaagtatgttttgttttgtttttttaattttctttcaaagttgtgcaaactattgaacggttggcataattctaagatttgccattgctacaaaaacactaaaaatagtaaaagcataaaaattccaattaaaaataaaaaacataaacaacaattttgcttagcataatgtaaagaacattttccattttcct

SEQ ID NO: 50346 - DNA, 480 bp, Homo sapiens
  misc_feature (420)..(420): n is a, c, g, or t
  misc_feature (438)..(438): n is a, c, g, or t
  misc_feature (462)..(462): n is a, c, g, or t
  misc_feature (468)..(468): n is a, c, g, or t
  misc_feature (480)..(480): n is a, c, g, or t
cgcacagatgggacgcggcttaggaggaatcctgggctgcaggcattccttggcctggtagtcagatttctggcacttgtagcaagctcctgggggagaaggttctggagtaacgcctggccgctgcggttcaggcatttggaagttcttgtgtgctggagatgtggctggggtttgtctcacagtggaggttacctaaccaaactcctgtaaaaccacaccacctatgcctgtgatggggactatctgaatctacagtgccctcggcatttctacaataagtgtccaatcggcattttatgggacaagattacccaatgtgtagttcccagaagcctgcctgccagaggggaagacagcttaacttgtgtgggcacccaccacctttccagatggatttaaaaaacaaaacctgttttnaagacaaggggttgaaantgcattgccttgattccaatttcntcaacntttattttgttn

SEQ ID NO: 50347 - DNA, 561 bp, Homo sapiens
ggaccaaagcgtagtacccaaaggaaactgcagtgagagcacaaagattctaggatactgtgagcaaatggggcagaggggtgctctcctgagctacagaaggagcggtctgatggttcagataaaacacaagttgctgggtgtggtggctcactgccgtaatcccagcactttgggaggttgaggcaggtggatcatgaggtcaggagatcaggaccatcctggctaacacggtgaaatcctgtctctactaaaaatacaaacaaaattagctgggcgtggtggggggcgcctgtagtctcagctacttgggaggctgaggcaggagaatggcatgaacccgggaggcagagcttgcagtgagctgagattgctccactgcgctccagcgtgggtgacagagtgagactccttctcaaaaaaaaaaaaaaaagataaaacataagtcaaactttattcaagttgtccacagttagcaatagtgatcttcttgctggtcttgccattcctggacccaaagtgctccatggcctccacagtcttcacgtcttctttcacctt

SEQ ID NO: 50348 - DNA, 718 bp, Homo sapiens
gcttaaggacaaacaaataccactatgcagaacctattttattacctgcagggttgacttatagacatttcttttgtaactccacagcatttactctgcccactgttccctcagatgcttcttcttgtactttctgtggctgaaggcatgatctgtaatccttctgttggcttggagtgtatattaatttctataaagtctgtttcatattgtttccccttgagtcatttttttccttcaggagaatatatttgagaatattcatgagacttggcaacagctcttgcacttcatgaatatgttttccggttgatagaggcaggaggcatggaaattcttggcagacaggggagggtccccagtgaaacccccacctttgagctgaaaagcctgaaacctgctgcccaaagttagaacttctatccctgttttcccactctctcctgattgcttctttctgaataatgtacttttaccaatagaatattgccttttccaaaactacctatggctcaccctgccccacatcctgtgcctataaagaccccagactcagtcagtagaagagagaaaagtggcttgactgtagagaggcaacttgactttagagggatggctggattttggaagagagacagcttgacttcagggaaagattacctgctcatcccatcccctgtccagctcccatctctgctgagagacatttccattgcta

SEQ ID NO: 50349 - DNA, 400 bp, Homo sapiens
accgaggttctccccagccaaggcgaggcggccgcagtgcgagatccacaccacagcctcggaagacaagcgagcagaaatcccatgaggggcagttgaggtttgaggaaggcgaggtgaggcacctgtggcagaaaaaaaaaaaaccgcaccacggagaagcagagcctgggtccccaacggacaaaagtgtcttcccattagcccttgcgctgggcccaggtgaccctggcattcctggttcgagaccagggtgcgcttcaggccgctaggggtacccaaaagcgggcagaaggcccatgaggtgaaggtgatgcacctggggcagagaaaaaaaaaaaacaaccgcgccgcgtataagcggggcctggctcccccacagaagaaactgtcctcacat

SEQ ID NO: 50350 - DNA, 545 bp, Homo sapiens
attaacatacacatgtgataacagtgcttcagtggctcattttagacttaaaatctaaactcctgggtggtatttttcaccaattccccaggaagtttttcatcaatggctgaatacttatggtggtttggctgtgccatgctctcctgaacctctgtatcttctcacttcttctgcccatctacctgattaacttttatttatcttttaaatctcacctgtttcctaggggaagccccctggtcttcagctacttaaacttaagttctgttgtgcccttggtcctatggccctgtgctcacgattattgaaagtctgtctccacactgtcctggaagctgctgcaaagcagggtcctgtcatttttgtgttcccaatgcctaacagtgcctggagtgctgcaggtgactggagaggtttgctgagaatggaacaagatcccaaaagggatcagattcataggtagaggaattagccttagttaagaatctccttatcttgagctaacaagctatgaaaatatgtttgacattaagaaatttcag

SEQ ID NO: 50351 - DNA, 335 bp, Homo sapiens
agtcaagtgagacgagatctggtacctcacgcactagatccctcctctccggcctggtgagaagtcagagacaattttgacagttcatagtcctgccttggctctcacgcttgcggtccatgggcgggttttaccttctctctcttcctctgcttctggcctgcttacaggccaacagcaaatgcagccattgcccgagaccactcagaactctccctgtgccatcctcttggggaacaggaggatatgtccgtagaagacttcgtggactggggaaagccacgccgggatcgggacgccggagagggtcgcccctccctaggctttttcccgtc

SEQ ID NO: 50352 - DNA, 174 bp, Homo sapiens
ctggggacctagctccctgtggggtcacctcccacccatgctgcttcctttctctttgggatgctaaggagtgagggccctgagttcctgggcactctttcctgagcttgcttggggctgatttgaattcagctacttcagagagttgaaaatccagctggaaaagctgcatgg

SEQ ID NO: 50353 - DNA, 2096 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50354 - DNA, 3059 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaaagtaagttataatttccatgtacacaggcgactggagctgttggtcagaaatactggcgtctgccccctaaaaagtaaatcaggaaaacccagggttagctgcaggactgaaaaaattattattttcacaaagttgccattaaggttattaatctgttctggtgccagaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgctttgaggctcaagtgaggcccagtatgacaaagagcaataggctctggctgttttagccagtaaaacagtgtagactgccactcctccaccccacgtcacccccattcctaaaagagcatcccaagcctagaggtccttgccacacagcacagctgtcacaggcagtacccacttgggtgccaggctggggaaactgcattcagaaaactctagagcctggggaaacaggacaggagaagactgttgtgcagtcagctttcctgagcacctactcagggcacccattttctcattacagtggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50355 - DNA, 2194 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50356 - DNA, 3084 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaaagtaagttataatttccatgtacacaggcgactggagctgttggtcagaaatactggcgtctgccccctaaaaagtaaatcaggaaaacccagggttagctgcaggactgaaaaaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgctttgaggctcaagtgaggcccagtatgacaaagagcaataggctctggctgttttagccagtaaaacagtgtagactgccactcctccaccccacgtcacccccattcctaaaagagcatcccaagcctagaggtccttgccacacagcacagctgtcacaggcagtacccacttgggtgccaggctggggaaactgcattcagaaaactctagagcctggggaaacaggacaggagaagactgttgtgcagtcagctttcctgagcacctactcagggcacccattttctcattacagtggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50357 - DNA, 3084 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaaagtaagttataatttccatgtacacaggcgactggagctgttggtcagaaatactggcgtctgccccctaaaaagtaaatcaggaaaacccagggttagctgcaggactgaaaaaattattattttcacaaagttgccattaaggttattaatctgttctggtgccagaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgctttgaggctcaagtgaggcccagtatgacaaagagcaataggctctggctgttttagccagtaaaacagtgtagactgccactcctccaccccacgtcacccccattcctaaaagagcatcccaagcctagaggtccttgccacacagcacagctgtcacaggcagtacccacttgggtgccaggctggggaaactgcattcagaaaactctagagcctggggaaacaggacaggagaagactgttgtgcagtcagctttcctgagcacctactcagggcacccattttctcattacagtggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50358 - DNA, 1820 bp, Homo sapiens
ccccgcggctgcaggatacggcacgagcccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50359 - DNA, 3138 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaaagtaagttataatttccatgtacacaggcgactggagctgttggtcagaaatactggcgtctgccccctaaaaagtaaatcaggaaaacccagggttagctgcaggactgaaaaaattattattttcacaaagttgccattaaggttattaatctgttctggtgccagaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgctttgaggctcaagtgaggcccagtatgacaaagagcaataggctctggctgttttagccagtaaaacagtgtagactgccactcctccaccccacgtcacccccattcctaaaagagcatcccaagcctagaggtccttgccacacagcacagctgtcacaggcagtacccacttgggtgccaggctggggaaactgcattcagaaaactctagagcctggggaaacaggacaggagaagactgttgtgcagtcagctttcctgagcacctactcagggcacccattttctcattacagtggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50360 - DNA, 3084 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaaagtaagttataatttccatgtacacaggcgactggagctgttggtcagaaatactggcgtctgccccctaaaaagtaaatcaggaaaacccagggttagctgcaggactgaaaaaattattattttcacaaagttgccattaaggttattaatctgttctggtgccagaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgctttgaggctcaagtgaggcccagtatgacaaagagcaataggctctggctgttttagccagtaaaacagtgtagactgccactcctccaccccacgtcacccccattcctaaaagagcatcccaagcctagaggtccttgccacacagcacagctgtcacaggcagtacccacttgggtgccaggctggggaaactgcattcagttcctgagcacctactcagggcacccattttctcattacagtggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50361 - DNA, 2046 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaacctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50362 - DNA, 2042 bp, Homo sapiens
gagagcgacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaataaaaaaaaaaaaaaaaaaaaaaaaaaaaaaaaaaaaaaaaaaaaaaaaaaaaaaaaacacaaaaaacaagaaacaaaacaaaaaaaaaacagaaaaaaaaaaacaaaaaaaagaaacaaaaaaacaaagcgtggggcggagcggccgcggagcgacccacaaagaagaacatacaacacacacgtgggggtgggaggaggggcggacacactgagatgagagacgagaggaaaacacatatgagagagcagagcgaaaaaaaaccggacggtaaaaaaacagagaggggcagggaagaggaacaccacacaaaaacaagagaaacccgcgcggcgggcagcagaagagactcggacgtcgacagaaccaaaccaccgaggagggaggaagatacgggaaggacgacagccatgaggaggagactaaacaacaacggaggaagaacagaggaagagcggggaggcgacatagataaaaaataagcccgcgcgagcgaggggaagaggaggaataagagaacaagagagaggagatgagaagaaggacggagaaaagaagaaaagcaaacgagaagagagagaaagagaagaaagtaggacaagagaagcaaggaggaagagggaagagaaagaaaagaggaggaggagacgagaagagagagagagaagaaggcgaacagtggagagagggacggtgagagagatcagcggagggaggataagaaagagtgaagaggacgatgaggcagggggagagatagagtagtgagagctgatggagagacaggaagggggacagaagagacggtgagatgagacagtaaagatggctgtagaagatcaaatacagatggatagggagcgagggagaaagtcgaaacaaggagaaatgagaggtgaggaggaagggagagaggaggggcaggcgtaggagtggggcggtgggggagagagggatgaagggagaagacaacca

SEQ ID NO: 50363 - DNA, 385 bp, Homo sapiens
agaatattaattacatttcttggtcattgttttagtggtagcctttgagtatgaaatatacactataacaatctactttcaaacaacactattccacttcattaatggtgctggtactttataacacagcatttccaatccttctgtcttattttgtattacattattatcattcattttacttattcataagccataatcacccaatacattgttagtattatttagagctgttacctattacatcaattaagaagaagacactagattttattttaaattttttcttctctaatgctcctacctttctttatgtatttctgtgtttttgacctatattgtttttcttttctctgaggaacttctattaacatggcttgcaagg

SEQ ID NO: 50364 - DNA, 997 bp, Homo sapiens
cagaacttttatttttaaaaactgaagctgaaggtgaagccatgctccaaagaattaaagaaatcagtggctaacaggtattcttgaacttacaagatggcagataagaaacagcttgctaaagccctctccacttgcaagataacaaaactgactgaaattggctggaactaatatgaccaactagagtctgtgcagactgagcttgctgacatcacagcccaaatttccacatttcattccagctactccagaatttgcacatgtggcccataaagaggcatgaagagacaactgtgcacgtcgaaggacttttcagacttcctctttccttccccagaatctaccccctaaacctttcctaataaacatactaccttaaggccaatttgcggggagacagatttgagctggactcctgtcttccttgttggttatctaagtaaagctttcctttcttcaaaaacctggtgccccctaagtttggaggtttgcttgagcccaggagtttgagattagcctgagcaacatggcaaaaccccacgtgtacaaaaaaataacaaaaattaaccaggcatggtggttagcgcctgtggtcccagctaccagggaggctgaagtgggaggatcaccccagctggggagactctgtctttaaaaaaataacaaataaaaaaaactcctcttcactcatgtttgtatcacctcctcccctctttgggcctcttctcttcattctggccaactgccaattttgtgtcacaggattcttcacccagtccttcccatcactggctctgttccaccctgaagttataatgtccacatttctgaggaaagaggtactaatgtgatgttggccccacactttctgcccaccttgtggtttgtttgtttatttatttgtcagagtcttgctctgtctcccagggtggagttgcagtgagctgagatcgtaccactgcactcctgcctgggtgacagattgagactttgt

SEQ ID NO: 50365 - DNA, 414 bp, Homo sapiens
gggtcgaccaattatatagttgttttgaatgcagtgctgcttgtttgcatcagaagtcagatatgttgagaccacaaattgtttctttcttcagttataattagtgggagtttttggtaaaaaattaaaagattggctggtcacggtggctcacacctgtaatcccagtactttgggaaggctgaggccggcagatcacctgaggtcaggagctcgagaccagcctggccaacatggtgaaaccccgtctctactaaaaacacaaaaattagccgggtgtgatggcgggcacatgtaatcccagctactcgggaagctgaggcagaagaatcgcttgaacctgggagggggaggttgcagtgagctgagatcgtaccactgcactcctgcctgggtgacagattgagactttgt

SEQ ID NO: 50366 - DNA, 437 bp, Homo sapiens
ttttcaaggagtctgcagactggcaaatgtaacagtcaattttatgtatcaacttgattggactaatggatgctgagatagctggtaaaacattatttctgaatgtgtctgggagggtgtttcttggaagcagttagcctttgaatttgtagactgaataaagaagagccaacctcactaatattgagtggtgaagccggctgaacttcctgggtccagtggggacttggagaacttttctgtgcctagctaaaggtttgtaaatgcaccaattagcactctgtaaaaacgcaccaatcagcactctgtaaaatggaccaatcagcaggatgtgggcagggccaaataagggaataaaacctggccaccccagccatgggcggcaacccactcaggtccccttccagactgtggcaggtttgttcttttactcttca

SEQ ID NO: 50367 - DNA, 593 bp, Homo sapiens
aaaaaagacagtagttgtggagtttgctttatagggaaggagatggcttctgcaaacatctgttctgaaggggcttgtgtgttggacactaaacatttatgtaaatttttagaggagacattgaattaggcacgtgtagcccaaagtgaggtcagatagtatagcatttgagtatctgagaaaagagataaaatattacacagctgtaggggtttggcaggtattggaaatgtgtaaggcagaacaaatgtgacaaagggaagtggcagcgactgtggacagtggtggtggtgacatcagcagcagtagctttagtaggggaagaggaagaggagaatgatcgtaataaataatagttaatatttatacagttatataggacctgttgaatacttgcatagctcatttagtatttatgataatcccatcagatgaaaagggcctaattgaggctgttaataatgaaagaaaaagcagtcagttttaaaggaaccaatctaaagaaatgaaccggctctccgggttgcatagctgttaagtctaaggtcaggatggcgcccaggcaggctccatccactgtcctccccggcact

SEQ ID NO: 50368 - DNA, 322 bp, Homo sapiens
atatgtttgataacttccataagaaaaacctctaagtgggtacatataaaaggattgtccatttcctatatatattattttaaatcagttattactctatgtatttattagaattatttcggttacaatgaacagaaaccccaattcacattggcttaaacaataaagggaatgtatagattcacgtagctgaaaagtactgggcagttctaggtatgaggtgatgcttgatcctacagctcaatgatgttaccaaggactgaatttctatcactctattctgctttctatgatgctgatttcatcctaaggctcatctatg

SEQ ID NO: 50369 - DNA, 578 bp, Homo sapiens
cctgagcttaagcttattttaacagtaaatctacttctgcatagtaagtaatcttaagagatgaaccaagaggttgtaatatgcctagtctatattttaagcatttattgcaattgtttggttattataagttgcttcatgtgaatcattttcttggatttaatgttcaactagaaacttgtagtgttttgttttgttttttgttttttttgaaatggagtcttgctctgttgcccaggctggagtgcagtggcactatctcagctcactgcagcctccgcctcccgaattcaagtgattcttctgcctcagcctcctgagtagcagggattacaagtgggtgccaccacacctggctaatttttgtatttttagtagagatggagtttcgccatgttggccaggctgatctcgaactcttgacctcaggtgatccactctccttggcctcccaaagtgctgggattacaggcatgagcatcatgcctggcctctatatttttatcttttcttccaggagccaaagctgctgctttttctccttttttttttttatgcttctctcctacctcctttaa

SEQ ID NO: 50370 - DNA, 299 bp, Homo sapiens
aactattactgctgtcccactttggaacatttataaccctaaaaagaaatctcccactccccatttcctcctgtttcccctaaccctaagcaaccaccagtctcctttctgtctctatgaatttgcctattctgaacctttcgtataaatgggatcatataatgtatggcctttcatgattggctgccttcaagtgaaattaatagtcctaaatatgcacctaataacagagcttcaagatacatgaatcagaaactgatagaacttgaaaggataagtagatctaaaattatagttgg

SEQ ID NO: 50371 - DNA, 261 bp, Homo sapiens
gtacattgaattggaaagtcttcaaaaagcagcagtgatgaattttttgagatttttaacaattacaaaaattcagggttttttctaatggatgccacctgagactttattttctgttattttcttgtaataactaaccaaacaagctcatgttgaaaaatgattactaaatttgagctaattgcaatgactggtttcaaaattttccacagtgtatttgagttaaaatttcactgtgaagagtactacgatcactctcgc

SEQ ID NO: 50372 - DNA, 1274 bp, Homo sapiens
ggcacgaggggtccaccccggcctggcctagcggagcccccgcgtccgcccgccgcagccgccgctccatccccagccccggccccgcatccagaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgccccccgagagtccatgaataaagctaatctgtctgtagcca

SEQ ID NO: 50373 - DNA, 1207 bp, Homo sapiens
gaccgtgtgactgtgccgtgcgtgtacaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgccccccgagagtccatgaataaagctaatctgtctgtagcca

SEQ ID NO: 50374 - DNA, 1309 bp, Homo sapiens
ggcggcgcggccgccagcgggggcgctgagctcagagctgccgcagcgccggagccggagccggagccggagcgcgcgagctcgcagggcgcgaggaacgagcggtggctggctacgcacccgagacccgggcactgctgcgctcctgctcaggacccgcgacccgagcgcctgatcccggccctatcccccctccggcccctggtccaccccggcctggcctagcggagcccccgcgtccgcccgccgcagccgccgctccatccccagccccggccccgcatccaggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgccccccgagagtccatgaataaagctaatctgtctgtagcca

SEQ ID NO: 50375 - DNA, 576 bp, Homo sapiens
gagagtatctagaggatccctcccgactagccgacaggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgccccccgagagtccatgaataaagctaatctgtctgtagcca

SEQ ID NO: 50376 - DNA, 541 bp, Homo sapiens
cggtgtggtgtgggttaggtgagatggaatcgtccttcgtgctggagtgcataacgcgtgtgagtgtatggaactgaaatggactgtttctgcctgtgtgacaggttcgtaatattttgctgttgttttggggaaaaaaaaaacccgtttttccacagagagcctatctctggcagaagtagccaacgagctggacacggagaccctgcggaggctgaagcgggagtgtgggggcctgcagacgctgctccggaacagccaccaggtgttccaagaccctgtattcagtggatcagctggcaccacccaaatagataaattggcccatctggtcttgtggcccccacccaggaatggactcagctcaagaggacagcttcagctccctaagattttatcttggacccgaacaatcagcactcccgacttactggccctctactcaccaagttatccttaaaaacctcaatccctgagttttcagagagactgatttgaataataataaaactccggtcttccacacggccgactctgcatg

SEQ ID NO: 50377 - DNA, 2690 bp, Homo sapiens
ggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagatgtcctcaatggaaccataacgtttttgcctttggaagaagatgatgaggggaacctaaaggttaagatgagcaatgtgtatcaaattcagctcagtcatagcaaagaagaatggttcatatctgttttaattttctgtccagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggggactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggagagagcctatctctggcagaagtagccaacgagctggacacggagaccctgcggaggctgaagcgggagtgtgggggcctgcagacgctgctccggaacagccaccaggtgttccaaggttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctga

SEQ ID NO: 50378 - DNA, 3081 bp, Homo sapiens
ggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagatgtcctcaatggaaccataacgtttttgcctttggaagaagatgatgaggggaacctaaaggttaagatgagcaatgtgtatcaaattcagctcagtcatagcaaagaagaatggttcatatctgttttaattttctgtccagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggggactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggagagagcctatctctggcagaagtagccaacgagctggacacggagaccctgcggaggctgaagcgggagtgtgggggcctgcagacgctgctccggaacagccaccaggtgttccaaggttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctgacatgggccactctaagtggcatgaaaaaaaaatcctaagtgaattgttgacagggctttaaaaatgtaaatatcacagatgacaaaggtaagacctacaccttcctccctcctccatgagaccctctccccagaaatactgcagcagtcctttttagtccttccagaaaaaaaaatcctgatttgtttctcttttatttttatgaagtgatagggtcttgatctctcgcccaggctggagtgcagtggcaagatcatagctcactgcagctttgaactcctgggctcaagccatccttctgcctcagcctgtcaagtgactgggactgtagatgcacgccaccatgcctggccaagattttactcatcgggggtcctctagaacgccgcgc

SEQ ID NO: 50379 - DNA, 1298 bp, Homo sapiens
agcacagatgttttctcgtgtttcggctctcacaccgtggtccctccttcctccactcaagtgatccttctaaaatggtggctctgcaggacctgcctctcagccagagggaaggtcggtggcctcaatgatgaggccacaagggacccagctctgtcctctgccctcccctctggctgtccctcgaatgtggccagtcctggtgcagtctgtcctgggacactcgggtttgctgctgctttgcctaaaatgctcttcctgggtctgcgcagggctgccgctcacttcccgcagggctcaccttccccggccttgcctgaagacacatcccatacctcagtcactcccactggaggcagactcactgtgaccagcaggaactctaggctgtgttccggttgtatccctgaccctggattggcacctcccgtggcgtgggagctaaagagaggctggtgaattaaggaactttcaggtttacttctcagtgtgtcttctctgttccaaaccacagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctga

SEQ ID NO: 50380 - DNA, 846 bp, Homo sapiens
acagtcagctcggtacccctcctcagcagacgcagttccggaacagccaccaggtgatccagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctga

SEQ ID NO: 50381 - DNA, 2546 bp, Homo sapiens
ggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggggactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggagagagcctatctctggcagaagtagccaacgagctggacacggagaccctgcggaggctgaagcgggagtgtgggggcctgcagacgctgctccggaacagccaccaggtgttccaaggttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctga

SEQ ID NO: 50382 - DNA, 1071 bp, Homo sapiens
ctgcactcatggcagagcaggcctttcctccttgaacatgtagacaagtctcagagaggtcagtgcgccggcccgatgtctcccagtgagtggagaggccacgccacagtccgggccaggtctgacccagcactggcacccctgagcctatggcatcatccgaggactgtaatcctcaacccgttcctcagagcaacttggtgaaagggagtgtctgtctgctgtcagaagcagtggtggagatggcggctcctgtgctgaggtagagtcccaggggatgcgcacggttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctga

SEQ ID NO: 50383 - DNA, 2253 bp, Homo sapiens
ggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagatgtcctcaatggaaccataacgtttttgcctttggaagaagatgatgaggggaacctaaaggttaagatgagcaatgtgtatcaaattcagctcagtcatagcaaagaagaatggttcatatctgttttaattttctgtccagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggggactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggaggtaagctgtccaccatcttagggaggggctagcacgctcccaggcttgagggcaggaattcacgtcttcagaaccgacatgaaatggtgtggccctgtgactacacactttgaaaaagccattgatggtgggtgcataggctctcttcaagcaaattctttaaaattttccaaatagctcttataaacataaaggactttgttatttccagggagtgacagagtttggacccttaattaacttttaccaaacatgcaggtttaggggctagaactactcattttcaatctagaaattatccaaagagaaaacaggttactgagtgcaagcaaaatgcactgtccccttgagtatgtggtaagatttggagctgttgtgattcgataatttaattctctttgaaatccccaaaacacaacaatcatccatggcaaaaggagaaaattacatcgattgttctcatgg

SEQ ID NO: 50384 - DNA, 4340 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactga

SEQ ID NO: 50385 - DNA, 397 bp, Homo sapiens
gtacagataaattaaaatgtaaaattttttaaaccaatttttatttttaaggaaaaagttttatatatatatatatatattttgtaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaaggtacatgccctctttcttttcatgccatctcttttgcactctcaggtggaaatatttttaagtgttttataatcataagttcttgtgaaacctaacaagattatcccttcctaggaatagcttaaccttcctaccaaattaaaaaaaaa

SEQ ID NO: 50386 - DNA, 481 bp, Homo sapiens
gggcctctgaagccagagaagacaccaaaattactagaagccacttgccagcctcagaggatgtgccggaaaaggccttttttaaacttgggtttaattggaaaaattcccaaccatgaaatcaccgaggaatatgatatacagaaaccaaaagaatacaaacactgtgctcttggtcaggagctcatttttgaggggatctcttttccccacttctgttacaggccaggcctaagttggacagtgtggtgaggagactacaggtgctgggctttatctttatggacaagcagaaaatcctttgcccaaaagggattacaagatgtcaggagtcacagccccctcctactccttgctcaaaaagtcttcctccccttggaatgttgtcttatacaccacaattggtactccatagtttaggaccaaggcattgctttgtgcaagctgtcattttaaaaatgtaggcatttcagaaaaaaaa

SEQ ID NO: 50387 - DNA, 8712 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgc

SEQ ID NO: 50388 - DNA, 8818 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgc

SEQ ID NO: 50389 - DNA, 5260 bp, Homo sapiens
gggaggatggacacatctacattccgaagagaaaatcgccgtctagacaatctccttgtgttatctgccacacttgtgccaccctcggcagtgtcagaggattaagctacgttgcttttgcctgaactgcgccgatttggttggggcaagacagcaagcagtattgaaatggttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgc

SEQ ID NO: 50390 - DNA, 5083 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtca

SEQ ID NO: 50391 - DNA, 3679 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaaggtgaagtatacctctactcagatgaattatcttctttttctttatttcacatcataaatgttataaaactgagtgtcagtgtaggtgaactctatgtatctgcattctcaaacaagactttttttttttttattatactttaagttttagggtacatgtgcacaatgtgcaggttagttacatacgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgaga

SEQ ID NO: 50392 - DNA, 2854 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaaggtacatgccctctttcttttcatgccatctcttttgcactctcaggtggaaatatttttaagtgttttataatcataagttcttgtgaaacctaacaagattatcccttcctaggaatagcttaaccttcctaccaaattaaaaaaaaa

SEQ ID NO: 50393 - DNA, 3894 bp, Homo sapiens
  misc_feature (3)..(3): n is a, c, g, or t
  misc_feature (6)..(6): n is a, c, g, or t
ggncangctcctaactccactaagtacagaagtggagccgtacagccatgaatgtcaggcatgttgtggggactagttgtattagttttctattgccaccataacaaattaccacaaacttaagcaatatagtacaaatttatcttaaagttattggcaggtcagaagcctgatacggatctcattgggctaaaacgaaggagttggcagggctgtgtgttcctttctgtaggctctgggcaggatccatttcctgcacttttttggcttttggaggtcgtccacattccttggctcctggccctgctccttcatcttcaaagctaccaaagatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactga

SEQ ID NO: 50394 - DNA, 5374 bp, Homo sapiens
taatacaaataatttaagtggtcataaaattgtttggaagaattgcattcttggggtgaattcatagcaccaagcctttggactctactttatttattgttacttaaacatctccttggttccattttaagttagaaaaatgtatctgtgtgggagtaaaaagatttcctttttaaaatcatttcagatatcaccatacttgattgggaactccatgtagataccttgaatattaaagtacttctttctactgctttcaagatagcagcacagccatcactaagttaaagcttattttaaaagctggggttacctgaggtttatcgtccttttcttcttttgaaattcttctgtgtgaaacttacaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgc

SEQ ID NO: 50395 - DNA, 6965 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgaaacaatgacaacaaaatttcatttaaagagacttaaataaaacaagatggagtcg

SEQ ID NO: 50396 - DNA, 3850 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaatattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggtatgaaatcaccgaggaatatgatatacagaaaccaaaagaatacaaacactgtgctcttggtcaggagctcatttttgaggggatctcttttccccacttctgttacaggccaggcctaagttggacagtgtggtgaggagactacaggtgctgggctttatctttatggacaagcagaaaatcctttgcccaaaagggattacaagatgtcaggagtcacagccccctcctactccttgctcaaaaagtcttcctccccttggaatgttgtcttatacaccacaattggtactccatagtttaggaccaaggcattgctttgtgcaagctgtcattttaaaaatgtaggcatttcagaaaaaaaa

SEQ ID NO: 50397 - DNA, 2054 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccgcggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtaggtagccctcttaaatgattctggttttacgctctgataacttctgcaatatagatccctttgtccacaccagagacacgaattgtgatttttttttttaatttaggaagttatatacaaaatagtagaatggtgatttagaacaatatattatctctcttagtcaacgccttgagcatatatcatggtggggtggagataggggtgtgctggtggaaaaggatggataaagattatatccaaaacttgttatcttgagtttttcacatttttaaggtgaatctagttttctgtcacctcatgaagtctgttgggaagcagagtaaagaggagttattctttaagacctattttcctaatgtgcagaacttttaggaggtacttagtgaaatacagaaagagggcatgaagaagtgtgaagtgtggtgtgct

SEQ ID NO: 50398 - DNA, 190 bp, Homo sapiens
gaaaagagagcctgcatgatggaaacattttttaaaacaaaagatgtatttcaattaaaagacatggagaaggccaggtgcggtggctcatgcttgcaatagtagcactttgggaggttgatgcaggaggactgcttgaggccaggagttcaagatcaatctggccaacatagcgagatgccatctcttg

SEQ ID NO: 50399 - DNA, 207 bp, Homo sapiens
aaccaattcattcagaacttgttttttgcatagtgtgatcacaagcccccagagaaaggtgacaacagagttgtacaagagacaagcgacatgacaaacatcacgagatgctttttggtgcagataactgagtatcagctactgtcaaatacccaacaatggccaacgacgtgaatgatggagcttaaaaaacagagactatacaga

SEQ ID NO: 50400 - DNA, 676 bp, Homo sapiens
tgagcattgtggatggattactatgttgagaaatgcataacaatgatgtgtaaggcagaacagtattctagtaggacggtagaacattcttgttaccttaacaagttcccctctatctttatagttagtccctctctgttaacacccaagtcctggctgccacagatctgttttctttctctgtagattggccttttccagaatgtcatatgaatggaatcatacagtgggtggcctcttgagtcaggcttcttagcacagtgcatttgagagtcatccatttccttgtttgtatcagtagttaattccttttcattgggtgagtcgttttccattgtttggctatgatcatagttttgtttatccactcatcagttgaagggtatttggattgttttcagtttttgtcaactatgatgaaagcctccctaaacactctcatataggttttcatgttaatatattttcattgctcttgggtgaatacctagaagtagaggattgctggatcatatagcagactgcatttacctttgtaagaaactaccaggcttcttctccaaagtggctgaggcagggaaatcacttgaacctggaggcagaggttacagtgaaccttgactgcaccagtggactccagtgttggcaacagagtgagattctgtaaaacaaaaca

SEQ ID NO: 50401 - DNA, 292 bp, Homo sapiens
cctattaaactttaggtaaacaattttgtgataacatttatcccctgcccctctcccctgttgattttttctggatgaggaaagcaaggctgtgccagccacgtaactcgtgtaaggacacacaacagtgcttatgtctccatcttcaggtcaaaccactttatgaagggcctactacatgccaggcaccaggctaggtgctagggaattgaaaggacccttttcataaaaccatcatgagggtctttgtgatttagagctcttctactaaaagaaactatgcatttactcc

SEQ ID NO: 50402 - DNA, 1000 bp, Homo sapiens
gacaaaataaattaatacagatacacaaacacatgtatgcaaaattatacttttaacaaagatatatgttttacttttgaaatatgtttcatttagactgcaaaacaagcaagaagatttattatgaatcagagttgtttgtgctctcaggaaggaagataatgatctaaccaatctctttcactgggaactgttttctgaatattataaggccccagggattccagatggaatacagtataattaactcttcaccaccaaatacctatgttagaagaccttgagaataaatgattgcctaatagcaaatggcatcctacttcttgactacacttgcacctgaggatacaaaaggacaaggtgtatttaaccttagaatgtctctataagatgaaaacaagtaagtgcaattatctccacttaaagtctaaagttggcaaacacttataagataaatgacttgctcaagactgactaggaagaagagttttagtataaaaacttaaactcattatctctttttacatgggactgaatggaggattgagaatggctctttatgtggaagataacatatttaatatattttcttttgttttaaggcagtattgaaatgaaaaaagaataaacttctagattctgatagtatacatggtaataatgtaatcattttagtaataattaagctatattgggtaatttttgcatgccaaacagcgtactgcatatttacatgttaaatcattccttttatgaaattttaacaatgacaatgatgtaatagcaatgattctatgaagaatctgctaagataaagaagcctaggccaggaactgtggctcatgtctgtaacctcagcacactgggacgccaaggagggagaatagcttgaggccaggagtttgagaccagcctgggcaaaacagcctagtttctacaaaacaacccagtctctacaaaaataaaaataacataaataaataaataatcctctactcaa

SEQ ID NO: 50403 - DNA, 385 bp, Homo sapiens
cactaccccttcgctcttctgtgctctttaggctcaaatcctcagtggtcagtcccttattgaagtgccttttttccctgaaagcactctagtaaatggaggtttagcattattactgaatcccagctttttctaatacatggagctcagtgcttactgtctgttccagagcaattacttatcaccattaccggagatttgagtcctctcccttggtgattagactctgaaggatagtcgttttaattttggtagttatgatttaatcttttcaagcttttattatggacaatttcaatatcaaaagcagaaagaataatgtagttcccatggacctattcctagcttagttattacccatggccagtcttgcttcatctgtact

SEQ ID NO: 50404 - DNA, 500 bp, Homo sapiens
actgtatcatggttgtccctcacattgcttgttattgcagggacggcaaactcaaaagcttacatggaaggtaaggtggaatgcaattcaaccttactgcttaaagatctgatttttcaagagaagcaatatatccgaatttttatttaaaatctatttttaaatgctggcaaacttgtgagaaatttcttaaaacaatgtgtagaatacacaaaacatgctgacagggctgaatctggcttggaatttaaaactttacaatctactttctaaaagccacttcttgagactgccagatttttttttaagttttattttgttttctataaaaattgtgttcagagctctgctctccttgttagtctttaggatgatgttcccattcctttattatataggtattccatagactcctattgttttttgtttttattcatcctcaaataacagacctgctacttatcgcaagacagggtagaaggccaccctcagtctgtcaa

SEQ ID NO: 50405 - DNA, 1112 bp, Homo sapiens
cttgaagcagcaactactgtacctgggccccaatcctgcactctcccctggctcctcatatgcaaatcaagggctggttctgcccccacaggctgccccctccccattccctcccactcctagcctggcccctaaccacgcactttaaccttgcttctttcttttatcttcttttgggagggcagagcctgtggtcattcctgccctggctctccttcccttgaactttgaggcttgtcatgaatttttaagtaagcgttttatcctttaggggaagaaacaaattaatttcctgcccatttcaaaaccacagccctagtatgtccactgtgtttcaggcatgtgtttgcatgtatatggagggagggaccatgttcttcctcctgtgccgccaagcccatagtttatctgtgctccctatctgcctccaccttccgttatgtccaagagtacccactgccccagtcactcctgatctgaagccaaagatggtaggaggggcagggccgacaagggaccgtggctactcgggacccaggcttcccctccagtgtgaggaagaagctctgacctagagagagatgaataggtactggggcttggtccctgccttcccagcagggaggaaagatgggattgagctgggggctgcactgataagatttctaaagtcgcaccccaaaagccaaactgggctggagtgaagagggggcagttttctctctaaatgtagcattgaatttggccctggtccctttaagtgctctgtccacccatctcctagtgcagcctcctggacagttggacccactcctgcagcccagtgttcccttcctcacactcaatacctcagccaggggccaagacacagaacttgaatagaggtcatgccccctccgcccccacactgcatccttgcccagtttggctgccatcagtattgtcccctgagaactggacaggcttcgtttacacagtacagggtctcccctgaggggggatccttcagcctccctcccctactcaagtttgctttattcacagtcttacccatcttttagttgtataccctgaatgtcttgccacccttgtcaagggtgggctgaggggag

SEQ ID NO: 50406 - DNA, 561 bp, Homo sapiens
ggtaaagaaattatttgtgcttgaacttgcagaaaactgccttttcccttcttctcttgcatcttaacctggagcttcccttttcttgagcctcagtgtgcttcccaactcaatttataattgacttcctgcagtttctccttaggacagggctttgttttgggggtggttaatttgtagggttcataggaaacagaccactcacagcactgctttttgccaccctcactctcagctatgagttgaggcccaggaagccttctgccagcctcagctgctgttctcagattaatctgctgagttctttttgcctagtaagaatctctgaatttaggaacacagatgttagcacttgtatttctaggttttccagttcccagggccattaaacatttttttcctttcctttccttcttccaaaaaaattggtgattcccctgggtccctgtggtttaacctcacaaaacgtccatgatgacaccctgttacattgttttgtcgtagttaataccttgttatcccagttgctcagtcagtttttgtgagagattcagggatctt

SEQ ID NO: 50407 - DNA, 524 bp, Homo sapiens
  misc_feature (1)..(2): n is a, c, g, or t
  misc_feature (4)..(5): n is a, c, g, or t
  misc_feature (7)..(7): n is a, c, g, or t
  misc_feature (9)..(9): n is a, c, g, or t
nntnntntntactttgaataatcttttatttccaattaactatgaaacaaacagttcagaaaaattccatgttgattttgcaaaaattttttttcttttgtatttttagtagagagggggtttcaccatgttggtcaggctagtcttgaactcctggcctcaggtgatccacctgccttggcctcccaaagtgctgggattacaggtgcgagccactgcacccagccaagaatttcagctccttggtgttaagagattattctttcatcaacagtgattagccaaaaacaacaaaaaaaggcttcaacggcccctttccaattctaatctcttcttcaggtacagagagcccggaggggccagatgccgtattgagacagggctcaggtgaggctcttaggcacgcagctgaagggagttcaccggcccagagggttgaagaccaacactaacattatgaacaaggcaggagttcctgctaacacacctcccactccctttcccttctcagatagaacccaact

SEQ ID NO: 50408 - DNA, 614 bp, Homo sapiens
  misc_feature (607)..(607): n is a, c, g, or t
  misc_feature (611)..(612): n is a, c, g, or t
atttgatcctttctagcattttggttttttccagacaaaaatctgtgtctataactcttgcctttattgttccttttatgtcatttatcaaggaaatctaagcatttcatgaagttctttgtttaaatgtttaccctatttttctctttactgttattcaaaatacaaactatttgtgtcttctcataaatgttcagtttagttagtgtgatgcggttatgcctccttaaaatttcaaactggaagataggaacgaggaggctacaaggtgtagtggagcaagcactggatgggcaatgcagcaatttacttataagacttcagcaaatgaactagctgtgtgactttaggcaagtcacttccctacactagatgcttcttgaaattccttttggccaaaatgttctatactttaatgaaatggaaactgatctacttcattttcataatgttttatttgtatccatacatatcaaaattataatgtagctggtattaaatgtttttaaaaagcatttcaactctatttatggcattaagaatttttttgctgatttcttgaaagaaataaaaagtacatgatttctgcttgtgtgtaaataagaanaaannaa

SEQ ID NO: 50409 - DNA, 344 bp, Homo sapiens
taccttattcaccccaggaagctaacttccatgtctcctggcttccagttgttaaccagtcgggagctctggcaagctataggagagaatggggacagaatatttctcctgctgtgcccttccctccagaattatgtcaggttggcttgtccctctgttgaagggtaacacttctctccaggaagccttctctccacaacacatttaccaacaactggtccctctggctgtagggatggcaacagctctgcttttgctagccccaggtaactgcactatctcttatgattctcttatatagcacctgtaccttcataattaatgtctttataagtgagcccccc

SEQ ID NO: 50410 - DNA, 387 bp, Homo sapiens
tcttatattttttaaaaagtatcatttttgtttgtcccaaattgtggttttggtttccctggagttaactagtatgtttcaaggactggataaaaggaaaagagctggacaacaagtggtcttcaaggtccgtttgttattcagttactcaaccatttttccaaggcaacaatgggcaatcctagctccaaaaggctgataaccactggtccagtccagtggttttcaattcactttagctgtggcatcctttctttgtgggtggcagaagagaatatgacatggtctctgaccataatgatacctgcctgagtataatcaaaatatgtgtcctccagaacctaccccaataagtataaaccctggggaatctgcccttccacggaa

SEQ ID NO: 50411 - DNA, 858 bp, Homo sapiens
aatagaagaatccaatttcttgccttgggttactgactctttcaattgtaactaagtacaatagcagttaagctcaagctgtaatagtagagctcagtggaagctaaaccaggcacagtaactgacaccatgtaggttgattatattttgcatctccctgcaagtctgttttatgttatttatagcttcctattcgtgtagacaccagcagtaaactggggaatatttgtggcaggaatttctaagaacaacctttagcatcatctcaggccctgatccatttccttttccacaaaattgtttgagattatatcgtatgtgttacagaaagaatgtttttctgtatgctcgaaactgtatactaaagtaaaataataaagttaaccagaattatccatggggaacaattccaattaaaataaaatgccagtatctggtaaaacctggtagtaatgctttttgtggtgatatccaggtaatgattagatgcagtaaacccgggtagtagggaagaagagagatgtggggacaagcagcccgaataccttgctggcatagcagctgcctacctgcacccggagacctgagcagatattactagggtattatttgacagccagcttagcagtcaagaaggacattgatttggggtagcatggcagaccacttcattggggctgaagacctgcatttattgatcacttactacatgccacgtatttcgtttaggatatatatgtgtgcatgtgtataattttaaaatataccccacggtagaggcagagctgttggcagtgagccgagatcgcgccactgcattccagcctgagcgacagagcgagactctgtctcaaaaaa

SEQ ID NO: 50412 - DNA, 967 bp, Homo sapiens
gtggtgaaaattagagagtcctactttctaaataatccaaggtgttgcataaattggtatctcagaggaataaactagcatttcatttcaaatttcaagtctttatcaaggattttacaatttaaagttacacatttgttataggaaaattaaatgcttcacttttgttttgttttgttttgttttgtaatgcagaaaaatatgatccattattcatgcaccctgatctgtcttgtggaacacacactagtagctgtgggcacattatgcatgcccattgttggcaaaggtaatgtatattcttaatatttgtcaagagaagtttatctaagggctcaatattttttaaatagaggaaatttcattctagaaaaaaggaaaagaactaaaaatgttgaaaaaatccgtatcattgcctaataaataacaaaagttatttgccctgtcatagatgtaaagtgtatgtcagatatgttttttaatttagctttatatccaagtctcttctatatcttccaaagaaggaagtggatctgtatcagtctgtggatgaagaaaagggtttttacagtaggataaactctagaagggtaatgttgtctttctttgggtccagggtggacaacttttgattccatagatgttagtacttgctttgttacttcccaaaattgtaatggctccctgtgatgagatgtcctgaatttgttctaccttggtgtttcctatgcttctacaaaaccaacaaatcaataataccattattctagaactatgctcacccagttatcatgaactacccctaacaactagccaccacattgtagtcccagctacttgggaggctgagacgggagaattgcttgaatgtgggaggtggaggttgcagtgaaccaagattgtgcaactgcactccagcctgggcgacagagcaagactccatctcaaaaacaacaacaacaacaaa

SEQ ID NO: 50413 - DNA, 6151 bp, Homo sapiens
  misc_feature (1)..(1): n is a, c, g, or t
  misc_feature (5)..(5): n is a, c, g, or t
ntcangtatgtgttaattagcaaaccaactgaatggtcagatgagctgaggcagaagttcctagaagggtttgatgcctttttggaattactaaaatgtatgcagtccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50414 - DNA, 744 bp, Homo sapiens
tactcttttagaacttttaatccatttggatttttaaaatcactcaaaaatcatgttaaaaataatttagtttaagattttcatttttgaactatttgtggaaacaaattattttaaatgttgaagcttatggctgtcatttatgtaaattaccattgttttgatacctcatgttctctaattgtaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaagtaagttttggctcatgacaactattacaaagcaatagtttgctttgaagataatgaaataataaatcaaggaggaaaacttagtctaggcaattgcatagtgttttccagatattttccaaactctaatcattttcttctagcagacctgtggaatgtgattttagtttttagagaggaacaggtgaaaatttaacagtttctaagctattaaattcctatgtatttatgaaaaccaagtatctggtttatttctagggaccctacttttaatatcttccatacacttttcaagagatgctcagtaaactggtagagggagatggaacaactcaaactgactttataggacagtctaaaaatcgaataaaactttttgctgtactggccatt

SEQ ID NO: 50415 - DNA, 6107 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50416 - DNA, 4792 bp, Homo sapiens
tctacattaagtggccagttactcacaacatttaaattccaagaaatatgccactatttatctctatttgttgtagcaattttttgtctgctttttttctttaaaacaagtcagtttaagagtcttttctcttatttaaataagtgagattatagaatagttttttaattggtatttacagtgaagatatttctgctttggaaaaaaatgtgcgttttagcatctaattgtctaattgaatggagcataatttcagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50417 - DNA, 5602 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggaagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50418 - DNA, 2680 bp, Homo sapiens
ggtttaaatatcagtactataagacttcattctatttggaactgaatacaaatgttggttactaatgtgtaaatgtgtaacgtatgactgatctctctacagagtagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50419 - DNA, 6053 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50420 - DNA, 5834 bp, Homo sapiens
  misc_feature (5656)..(5656): n is a, c, g, or t
  misc_feature (5757)..(5757): n is a, c, g, or t
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggcttttatctcgtgccgaattcggcacganccccaagagagaaggccactgatgagggcaggagagagacgaccgtgtaccgagggctggtccagaagcgcgggaagaagcagttgggctcgttgaaaaanaagttcaagagtcatcaccgcaaacccaagagcttcagctcctgtaaacagccaggttaataaaagcacatgccgtg

SEQ ID NO: 50421 - DNA, 3499 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtaagttttgctgttagcattgaacattccctgccactggaaacacctctctacaaaaaatttgaaggattttgttgttgttctttgtttgggtagagaaatcatatctgtagtcctttatgagaggagagggagaaa

SEQ ID NO: 50422 - DNA, 2599 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaagtaagttttggctcatgacaactattacaaagcaatagtttgctttgaagataatgaaataataaatcaaggaggaaaacttagtctaggcaattgcatagtgttttccagatattttccaaactctaatcattttcttctagcagacctgtggaatgtgattttagtttttagagaggaacaggtgaaaatttaacagtttctaagctattaaattcctatgtatttatgaaaaccaagtatctggtttatttctagggaccctacttttaatatcttccatacacttttcaagagatgctcagtaaactggtagagggagatggaacaactcaaactgactttataggacagtctaaaaatcgaataaaactttttgctgtactggccatt

SEQ ID NO: 50423 - DNA, 684 bp, Homo sapiens
tatttttagctgaatttgtatgtaattttgctaaagggatgttaaaataatcatttgctataaaaagtcacttttgaatccttaaagaattctagttgttggcaacttgtttgtaaaagacaaatatgtcacattctcaagaagtattgaaaatctctattttggtagagccataatcaaattatgggcaataggtgttataagcaactgcatttatgttcctgtgcgtaggaataagtactatgaagtattagctattgttattgtgccttttatttttctgccgtagaacctggtgaagcgccaaaaaattctcctagcatactagctatgctggaaacactacaaaatgctccctacctagaagtccacaaagacatgattcggtggatattgaaggtaaaatttccacattcctctgctttttgtgagaaatattgaatatttgttatgtgtacattgtgatcatatttcatacaggatactgatacttttttttttgtagacttttaatgctgttaaaaagatgagggagagttcacctaccagtcccgtggcagagacagaaggaaccataatggaagaggtataaacagtaaaaagtgtgataatactaaaaaattacagcaagttcagtatgaacaaaataaatttatctacattaagtggccagttactcacaac

SEQ ID NO: 50424 - DNA, 348 bp, Homo sapiens
ccaataacttgtaaccttgcctaaatcaggaagggttgggttataatagaggaataaacagaacacattctgagtgacatgtgtcttctctttctagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttc

SEQ ID NO: 50425 - DNA, 555 bp, Homo sapiens
gcttaatgtcttcagtccttttgataacacttaattggaaaatacagagtactagtatttccttatctttcagaagagaatggcatggatcaagaaaatcccccttgtgaagaagaatcagcagttcttgctttgtataaaacacttcaccagtatacgggaaggtgagttagttatctttacataacgcatttccctaaatattgctagatgatgatagcatgagaaaggaattcgtttgttaattaggggaatttgttgtctgttgacatgtttttaaaataagacgtggagtgatctgcagagcctttctgaactattcatatactaacataattggaaatctgggagaaaggtgataatatgcagagcttcccacatttatttggctgtggaacccttcatttgctcagggatctggcagagactagaggatagatcaaatgtactttggaaagttgatactctaaaacttatgttgtctcattcagaatgggaatttaaaactgcaagttaaattggcataatttatttttaaggtaatattcagtagta

SEQ ID NO: 50426 - DNA, 470 bp, Homo sapiens
gatttccttaccccttctgagtataattcttttatgagaaacctcaaaaagaaaatatttaggaacctagttgagagacttgacctggttatcgagacgtcctctgactcttattttgctttatgggctgaggttagtattttaacctctctgtgcttttaacctgtaaagagataaaaacaccagcaacgggtcaggtgtggtgactcatgcctgtaatcccagcactttgcgaggctcaccccagatcacttgaggtcaggagtttgagagcagccttgccaacatggtgaaaccctatctctactaaaaatacaaaaaattagctgggcgtggtggcacatgcctgtaatctcagctactcaggaaagtgagacaggagaatcacttgaacccaggaggcggaggttgcagtgaccaagattgcatgactgcactccagcctggatgacagagcaagaccccatcca

SEQ ID NO: 50427 - DNA, 300 bp, Homo sapiens
gggaaggattagagagagcctgagccaataaaaactatttactcaatataattacttttttttttagatttattactaccataatgtgaaatgcagacgtgagatgtttgacaaggatgtagtaatgcttcaggtaatgaattaaaagcattgaacttaaaggttgtggggaatctttgcttcttgttatttccatagaattcagtcacttgtgatcactcccaaatctacaactccagcctagccctgtctcctcagctccaaactcatatggctaacagcctttagatcatttccatc

SEQ ID NO: 50428 - DNA, 745 bp, Homo sapiens
gagaactgctttgcatttttgttttttgttaattgcgttggtttattttaggatgactgtcttaggtcattgacgagatttgccgcagcacactggacagtggcatcagtttcagtggtgcaaggacatttttgtaaactttttgcatgtgagtattaatacatttataacatgttgtaatttttcatcctctgaaattttgtttttaatggtacagcttctctcaataatgaattaaatatttagtagtactggttttcttatatataagctctagcttataaattctcatgtgtcttgcaagaagataaatttaaagcagattatatgcattttaacatgttggcatatgaaatatgctaatgtatttctctttaaatctgtagcactggtgcctaatgacagccatgaggaacttccatgcatattagatattgacatgtttcatttattggtgggtattgtgcagtttgtttggacttctacgtcatactatgtaactttaccttaggtttggtgagcagtgtagtggcagacaggaaggagttatgtgatttccttaccccttctgagtataattcttttatgagaaacctcaaaaagaaaatatttaggaacctagttgagagacttgacctggttatcgagacgtcctctgactcttattttgctttatgggctgaggttagtattttaacctctctgtgcttttaacctgtaaagagataaaaacaccagcaacggg

SEQ ID NO: 50429 - DNA, 2492 bp, Homo sapiens
cctctgggtgctcgcttcggcagcacatatactaaaattggaacgatacagagaagattagcatggcccctgcgcaaggatgacacgcaaattcgtgaagcgttccatatttttaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttc

SEQ ID NO: 50430 - DNA, 3885 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttc

SEQ ID NO: 50431 - DNA, 4252 bp, Homo sapiens
tactcttttagaacttttaatccatttggatttttaaaatcactcaaaaatcatgttaaaaataatttagtttaagattttcatttttgaactatttgtggaaacaaattattttaaatgttgaagcttatggctgtcatttatgtaaattaccattgttttgatacctcatgttctctaattgtaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 50432 - DNA, 6187 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttagcaaaaaaacaaaaaaaaaaaaaattggtgggggcgggccgcgaaatttaaaccctcctgtggggggcgcccaagttgacaggccaggcccagaacccgggcggcatgcgtggttccccaaaaagccggggcgggttgaaacccggggcggggcggttaaaggccgga

SEQ ID NO: 50433 - DNA, 2722 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtaatgtatattcttaatatttgtcaagagaagtttatctaagggctcaatattttttaaatagaggaaatttcattctagaaaaaaggaaaagaactaaaaatgttgaaaaaatccgtatcattgcctaataaataacaaaagttatttgccctgtcatagatgtaaagtgtatgtcagatatgttttttaatttagctttatatccaagtctcttctatatcttccaaagaaggaagtggatctgtatcagtctgtggatgaagaaaagggtttttacagtaggataaactctagaagggtaatgttgtctttctttgggtccagggtggacaacttttgattccatagatgttagtacttgctttgttacttcccaaaattgtaatggctccctgtgatgagatgtcctgaatttgttctaccttggtgtttcctatgcttctacaaaaccaacaaatcaataataccattattctagaactatgctcacccagttatcatgaactacccctaacaactagccaccacattgtagtcccagctacttgggaggctgagacgggagaattgcttgaatgtgggaggtggaggttgcagtgaaccaagattgtgcaactgcactccagcctgggcgacagagcaagactccatctcaaaaacaacaacaacaacaaa

SEQ ID NO: 50434 - DNA, 2102 bp, Homo sapiens
aatagctgggagagtctagaggttgtgcttttgatactaaatgtatgaggatgatcactactccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccaggtaagtcatagctagatcctcatcttcccttttaataacaactgccagttaatgtggttggtgatacgttgagattttttaaacctaaaaataactccatggacttggatggtatctttggcaggtaacttaggcaggaattccccacttgg

SEQ ID NO: 50435 - DNA, 1014 bp, Homo sapiens
agcggcggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgatggaaaagcgcccgaaggcagcccccacggtggatctgtgcgaagccggtattcagggacctggatttttgaccaagcattgagatatgcatctgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcagtgag

SEQ ID NO: 50436 - DNA, 954 bp, Homo sapiens
agcggcggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgatggaaaagcgcccgaaggcagcccccacggtggatctgtgcgaagccggtattcagggacctggatttttgaccaagcattgagatatgcatctgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaaaaactggcaattacacctgtgaattctgcggcaaacagtacaagtactacactccctaccaggagcatgtggccttacacgcccccatcagtgag

SEQ ID NO: 50437 - DNA, 1680 bp, Homo sapiens
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtg

SEQ ID NO: 50438 - DNA, 1399 bp, Homo sapiens
tagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgatccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactatta

SEQ ID NO: 50439 - DNA, 569 bp, Homo sapiens
ccacgcgtccgggcgcccacagagccgcggcaccatggcacctgctggacgcccgggggccaagaaggtgagtttcgtcccctcgatcctcgcggagctcctggccgctgggctgcgagcgactccgttcacacccggcgttcatccctagccaagccctggggcctcggcaaaacacttggacgggatggccctgagcctcaattttcccctgtcacgggttggttagcgtttatggagcccttactcggtgcctggcgctgcacagagtgctgtgctcaagttatctcctcatcttcacaattatccccatttcacaggtgaggaaactgaggctcggcgagtcaggcgactagctcagggtcacgggtccagccccgcggggagcgaggatcagaagtctagctttcggacgcatgtcgcgcacacattttcttccctcaaccgaccctcgcccgcagctctttgggctaatccgtccgggaactcttcggactgtgccctcgcgttttggctagtcctgggcaggacgcccccagagctgcggtgcagggtggggggtaggtggg

SEQ ID NO: 50440 - DNA, 352 bp, Homo sapiens
gtagcaactgtcttaactcactgcaacctcacacctcctgggttcaagagattactcactcctcagcctcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattac

SEQ ID NO: 50441 - DNA, 2927 bp, Homo sapiens
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttacctttaaaaaacaccctactgtcttttaaagtctgcaagtcgtatggtccgcagcctttggttgcctctcctccgcttcgaggctgcggtcgcatcccctcgcccgcctctcgctctcctctgcgcgtcgcgggcgcgctcctctctctcggtcctcgctgcccgcttctctcttcccgcggtctttgtgtcctcctctgtcgctcgtcgttttactgtcgtcgtgtctgcttcgcccagctctcgtcgctctgcccctccggtcgttcattggctgctacgcgctcggcctcgttcacctcctcgcccccg

SEQ ID NO: 50442 - DNA, 3171 bp, Homo sapiens
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgtgagaacagtaacagtgctgttctattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttacctttaaaaaacaccctactgtcttttaaagtctgcaagtcgtatggtccgcagcctttggttgcctctcctccgcttcgaggctgcggtcgcatcccctcgcccgcctctcgctctcctctgcgcgtcgcgggcgcgctcctctctctcggtcctcgctgcccgcttctctcttcccgcggtctttgtgtcctcctctgtcgctcgtcgttttactgtcgtcgtgtctgcttcgcccagctctcgtcgctctgcccctccggtcgttcattggctgctacgcgctcggcctcgttcacctcctcgcccccg

SEQ ID NO: 50443 - DNA, 3758 bp, Homo sapiens
tagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgatccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgtgagaacagtaacagtgctgttctattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttacctttaaaaaacaccctactgtcttttaaagtctgcaagtcgtatggtccgcagcctttggttgcctctcctccgcttcgaggctgcggtcgcatcccctcgcccgcctctcgctctcctctgcgcgtcgcgggcgcgctcctctctctcggtcctcgctgcccgcttctctcttcccgcggtctttgtgtcctcctctgtcgctcgtcgttttactgtcgtcgtgtctgcttcgcccagctctcgtcgctctgcccctccggtcgttcattggctgctacgcgctcggcctcgttcacctcctcgcccccg

SEQ ID NO: 50444 - DNA, 2165 bp, Homo sapiens
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttacctttaaaaaacaccctactgtcttttaaagtctgcaagtcgtatggtccgcagcctttggttgcctctcctccgcttcgaggctgcggtcgcatcccctcgcccgcctctcgctctcctctgcgcgtcgcgggcgcgctcctctctctcggtcctcgctgcccgcttctctcttcccgcggtctttgtgtcctcctctgtcgctcgtcgttttactgtcgtcgtgtctgcttcgcccagctctcgtcgctctgcccctccggtcgttcattggctgctacgcgctcggcctcgttcacctcctcgcccccg

SEQ ID NO: 50445 - DNA, 453 bp, Homo sapiens
atgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctgg

SEQ ID NO: 50446 - DNA, 621 bp, Homo sapiens
  misc_feature (588)..(588): n is a, c, g, or t
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttcatgcatgatataacccccggagaatgtgctgtgaagcttgtggcacgggctttcatcgntggcgtgctgccgctttggccccacaccgcttg

SEQ ID NO: 50447 - DNA, 2881 bp, Homo sapiens
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttggccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttacctttaaaaaacaccctactgtcttttaaagtctgcaagtcgtatggtccgcagcctttggttgcctctcctccgcttcgaggctgcggtcgcatcccctcgcccgcctctcgctctcctctgcgcgtcgcgggcgcgctcctctctctcggtcctcgctgcccgcttctctcttcccgcggtctttgtgtcctcctctgtcgctcgtcgttttactgtcgtcgtgtctgcttcgcccagctctcgtcgctctgcccctccggtcgttcattggctgctacgcgctcggcctcgttcacctcctcgcccccg

SEQ ID NO: 50448 - DNA, 1947 bp, Homo sapiens
ccacgcgtccgggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattac

SEQ ID NO: 50449 - DNA, 250 bp, Homo sapiens
gcctactactactactaaattcgcggccgcgtcgacctctcatccccacttcccatggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaaaaaaa

SEQ ID NO: 50450 - DNA, 1129 bp, Homo sapiens
ctcgagcgcgcctcgcgcggccgcggcgcgagccgggacccctggaagggtcgggtgcgcggcccaggaggtaccgctgtctcctcacaatcggccaggcctgcagccgctgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaaaaaaa

SEQ ID NO: 50451 - DNA, 969 bp, Homo sapiens
ctcgagcgcgcctcgcgcggccgcggcgcgagccgggacccctggaagggtcgggtgcgcggcccaggaggtaccgctgtctcctcacaatcggccaggcctgcagccgctgccgccgccgccgccgccgccgccctactcagggagtggcccaggcctgcggcgcgccaccctcacctccttcattcctaccgtcaaagcccagccttggctacctgacccccctgtggtctcgaactcggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaaaaaaa

SEQ ID NO: 50452 - DNA, 1061 bp, Homo sapiens
ctcgagcgcgcctcgcgcggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaaaaaaa

SEQ ID NO: 50453 - DNA, 276 bp, Homo sapiens
ctaaactagtttttatatactggaaactattaacgtttgcttttactgtttccagatctggagttgagaaatgagatggtttagaacctaaagataaaggaaggaggaacctcatcatcagtgaatactctgaatatccacaacatactacatctgcaggctttcaacttttgttgacctctttggaactctataagctccagaatgaagatggaaaaccagtgagctacatgaattaagtggaacacagatcagcatggtttcagttcctggagg

SEQ ID NO: 50454 - DNA, 331 bp, Homo sapiens
  misc_feature (268)..(268): n is a, c, g, or t
  misc_feature (271)..(271): n is a, c, g, or t
  misc_feature (281)..(281): n is a, c, g, or t
ttactttatactacattgatagtgagaagttaatggcttctctatcccccacactgtctcatgcctttgcacagttcgaaaggaagacttggagtttacaatcagaacctggaccctaaagaacagtgactgcaaaggcaaagaaagtaaaaaaggaattggccattagacgttcctgagcatccaagatgaacattttgtagtgcaaaagacttttgtgaaaagctgatacctcaatctttactactgtatttttaaaaatgaaggntgntattgcaagnttaaaaaggtaacagaattttaactgttgcttattaagcaaccttcttgt

SEQ ID NO: 50455 - DNA, 1894 bp, Homo sapiens
tggataaagaaaatgtggtacataaacaccatggaatactacacagccataaaaaagaatgaaatcatgtcctttgcagcaacatggatgctactggaggccactatcctaagcaaattaatacagaaatggaaaaccaaataccacgttctcacttataagggaaagtgaaacactgggtatacacggacacaaagatggaaacaataaactctgggaattccaaaaggggagagatagggggtgagggttgaaaaactacctattgggtactatgttcactgcttaggtgacaggatcattagaagcctaaacctcagtatcacacaacatacccatgtaacaaacctgtacatgtacccctgaatctaaaataaattttttcaataaagaaagaaaggttcttggaggagatagattcgatgttaaatcttctttcatcagcacatgtgtattgactgtcactctctaccaggctgtattctaggtaatggatgtaggagagaacaaaaaggtctctgctgttctgaagcttatagtctattggggagagatagtaaataagacggaaacaaataaatacacagtttcagagagcaatgagttctacaaatgagcagtgagccctataaacaaaatttagattaaattaaattaggataggtcagcctctttgttatagcagatgatactttttatatggtttagcaaagagtcaggaggaagtaattttaaaaagaaaacaaaaaaacctcttaccaccactttaagccactgtggtgattgagcaaacacaaagggaaagtcaaacctctgtcatttgcctggactatctggatgtgatgtaaactgggaaggtgaactttatgaaatctatgcaactaagatcagaagctgagctatgcccctcaaggagtgatatcttacaattttatcttaaacatgggtcatattgatcatttatgtcttaatttagtgatataaaattagagcctgaaagagtacctaaaaacaattgtccacacacaggacagttctgaaagaaatttatataacactattatatgcagtgtttttcaagttttcatttattaaaatcaccaaattaagtcatcctttcatacgctgtgattcagttaaaaggggcttttgttgcagaagctctagttaaggtttgaaaatcgatttctctacttctgcttccaagaggatggagtaggcatactttgccctattcttcccactaagtacacctaaaatccctagacatacataaaacaaatgtaagaacattctggaaggtaaagagaagaagacggactgattagggtccttgagacttgaggggcgccatagtgatgagctccaggggactttctttttgcctcatgtatccagacttggagccgaagtcgctgggaacccagaaacagtaatcggcacagactttagaaaaacaacaataaaagctgactttctctaaccaaataaccaggaaagggacagcccagcaagacacaaaagttttagaccataaatgtgctactgcagctgaacaccacaggaaacactgtggtcccccctcacccacaccagcaagggctgagtcaagtgagacttctccccttgctggggtggtgtcagagaagaccaagccaggagccagaaatttcatccccactggtcagtaaggaagctcgtctgctcccagagtttcagtggagaccacgtgggaattctggattctcacccccactcagcagtaaggaggcacctacccctcccccactccctggccagttgacacccagtagaaaacccagatgcctgcattcacctggcggtaacaagatggtggcagccaccttcccctgctagagcagtgtcaaaaaaa

SEQ ID NO: 50456 - DNA, 375 bp, Homo sapiens
ttaacactggccaaggcacttgaatgcaaagcaaaagtgacaaaagggactgaggttgcagtacgggaagtacactactgtgtcagtagttaaaggtggtggccttgatttctcagagggagaggaatcagctttgaagatgcctgtcacagacactagaaaatccaaccatctagggcattgtgtctgctgactctgtgctgagggatagagctagaacccaaattccaggtccctgtgtgttgaaaacagtcaatcagcattctgaccctgccctgattactttgaattcagtggcctggaaagccccattgatttcactgtctgatttctggaagtcaattgaaagagaaacatagcagcaagaacctaaaa

SEQ ID NO: 50457 - DNA, 272 bp, Homo sapiens
gaattttgttcatatatttaacaaccttcctttgccaggaccttttttttccccagtgcccaatcttggttgggatagaagtagccctgacttttttttcctgtttattactcatattatatgtcttataggctttttcattcacgcatacatttctaaaccaaatgccgcacagcgtaactgatacaaataatgatttcatgtccactattgaaaatttggggggtgggtgcagtgactcaatgcctgtaatcccagtactttgggaggct

SEQ ID NO: 50458 - DNA, 511 bp, Homo sapiens
cgagctcggtaccccggaagcacatcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgtgcttccggggacctctagacagccacca

SEQ ID NO: 50459 - DNA, 147 bp, Homo sapiens
tcaagcttctaacgatgtacggggacatgtaggtagctcattcagggccttgctcttcacttcaaaaaaggttcccttgaggactggctgtcaatttgtgttgctgtgttggttgttgatgaaaataataaaatgattgattacata

SEQ ID NO: 50460 - DNA, 1525 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50461 - DNA, 1656 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggagaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50462 - DNA, 1760 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50463 - DNA, 1474 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50464 - DNA, 1732 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtgggagaaacagaaaattctgagtagcactgtactgtacgcaacaaatgtcagggccctattgatttgtctgaggtgttagtgaagggtgttattttttcagatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50465 - DNA, 1496 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50466 - DNA, 2327 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggagaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50467 - DNA, 1861 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaataccttaaaataactaatttgctttcctttccaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50468 - DNA, 1979 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50469 - DNA, 2092 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggagaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50470 - DNA, 1454 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagcaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50471 - DNA, 1961 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50472 - DNA, 2163 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50473 - DNA, 2965 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggagaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50474 - DNA, 1709 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50475 - DNA, 2781 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggagaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50476 - DNA, 1427 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccaggtattcctgatgacagtctgcctctatcttacagtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50477 - DNA, 3519 bp, Homo sapiens
  misc_feature (5)..(5): n is a, c, g, or t
  misc_feature (7)..(8): n is a, c, g, or t
  misc_feature (10)..(11): n is a, c, g, or t
gcctncnncnnctactactactaaattcgcggccgcgtcgaccggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtgggagaaacagaaaattctgagtagcactgtactgtacgcaacaaatgtcagggccctattgatttgtctgaggtgttagtgaagggtgttattttttcagatgttcagcccacaagagcttactggtgaaggaatgggacaagacccatctttatgcaaagccagcgttacagtaatgttccagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaataccttaaaataactaatttgctttcctttccaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggagaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50478 - DNA, 1713 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagtactactaaccaataacctgcttggctcaaagggccagcaccttctctctaaagcccaagaggagtttgaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50479 - DNA, 1365 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50480 - DNA, 1398 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccaggtattcctgatgacagtctgcctctatcttacagtactactaaccaataacctgcttggctcaaagggccagcaccttctctctaaagcccaagaggagtttgaggaaaactaggtgtctgtgttcactccaggctgaagttacaggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50481 - DNA, 1551 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacataaaaaaaaacactccaatcactcacac

SEQ ID NO: 50482 - DNA, 1512 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgtgcttccggggtccgagccgatcgaa

SEQ ID NO: 50483 - DNA, 1764 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacataaaaaaaaaaaaaaaaaaaacacccgagagggctctctttttgctcgggtgtcgggggaaaagagagggtgtattgagaattgggccctttgggcccttcgcttgtgttctccttggcacccaagtttctctttggtccaagtgggtgtaatctcctgccggtccctccccttataggggatgccggtttaatttccgaataacccaggtgttacccttggctttattgaatcccggaag

SEQ ID NO: 50484 - DNA, 1515 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgtgcttccggggacctctagacagccacca

SEQ ID NO: 50485 - DNA, 1504 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcgagcttccgttttagcttccccgtgcagactaactctcagatattctgtttcccttgccctccggtgt

SEQ ID NO: 50486 - DNA, 1306 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50487 - DNA, 1485 bp, Homo sapiens
  misc_feature (911)..(911): n is a, c, g, or t
  misc_feature (914)..(914): n is a, c, g, or t
  misc_feature (924)..(924): n is a, c, g, or t
  misc_feature (999)..(999): n is a, c, g, or t
  misc_feature (1002)..(1002): n is a, c, g, or t
  misc_feature (1009)..(1009): n is a, c, g, or t
  misc_feature (1016)..(1016): n is a, c, g, or t
  misc_feature (1018)..(1018): n is a, c, g, or t
  misc_feature (1021)..(1021): n is a, c, g, or t
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaaggccancancttctctctnaaagcccaagaggagttgaggaaaactggtgtctgggttcactccaggctgaagttcaggtttgagcaaataggngtntaaaaanggaatcngnctnggaggacatcagaagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50488 - DNA, 1274 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactcttcccatggtcgtttttcctctagagtcagc

SEQ ID NO: 50489 - DNA, 774 bp, Homo sapiens
tactggccccagttacaagcatgtcccatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 50490 - DNA, 992 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagcctctgggcactgtttggactctg

SEQ ID NO: 50491 - DNA, 1203 bp, Homo sapiens
tgctagtagggcctgggttaatcggccgagggggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagcaagtagccataacccaggagaaggacccctagcagggttgcagtctgtaggagcacaacacgcttccgagggcagtaatgcagatatgccaagatatacagggtctgaagcgcagcacccactgtgttgacgacgatgaggatcccgtctcccttcaaagccccataactcagccagcccaggttgttgacttccgtggtgagaaagggcaggaactggacgttgtccacgctc

SEQ ID NO: 50492 - DNA, 775 bp, Homo sapiens
acaggttagcttacaaaatctaaatgaaagaagttgggcacaaggtgacagtttaagtaacttgaccagtgtcttaatttaaatccaggtgtgtctgacttcagagcccatgctcttttcaaggcgggggcggggggggcttcatcttattttgcctaaaacagctttattacacatggtcatgcttaaagcctatgtaaataggaaacatgtctagtttgtgttatgttacggtgttgagttagactagggattaaatgacagcagtgttaggtcatatatctttggatttaaacactttaaagactacagcctagattattacctttcagggtaatctaactaccatctacagagctagctactccttggtgattatggagtggcctgttagcattgttttctgacaatttaagaaactcctttttgatatatacagaaaatgtatccctggtttacttttcttgttttttccccctgggtttataataagtttgatacatttaattttgggagtgacatccattttgtcaagaaaacccaagaaagaattgaagtaggttgatcagtcaacatataattttttccttctccttcttgagacaggatcttgctctgttacccaggctggcgtgcagtagcatgatcatagttcactgcaaactcaacctctgaggtgggagaattgctggaacccaggaggcggaagttgcagtgagctgagaatgtgtcactgcactccagcctgggcaagagagcaaaaactccatctaat

SEQ ID NO: 50493 - DNA, 721 bp, Homo sapiens
acaggttagcttacaaaatctaaatgaaagaagttgggcacaaggtgacagtttaagtaacttgaccagtgtcttaatttaaatccaggtgtgtctgacttcagagcccatgctcttttcaaggcgggggcggggggggcttcatcttattttgcctaaaacagctttattacacatggtcatgcttaaagcctatgtaaataggaaacatgtctagtttgtgttatgttacggtgttgagttagactagggattaaatgacagcagtgttaggtcatatatctttggatttaaacactttaaagactacagcctagattattacctttcagggtaatctaactaccatctacagagctagctactccttggtgattatggagtggcctgttagcattgttttctgacaatttaagaaactcctttttgatatatacagaaaatgtatccctggtttacttttcttgttttttccccctgggtttataataagtttgatacatttaattttgggagtgacatccattttgtcaagtctccttcttgagacaggatcttgctctgttacccaggctggcgtgcagtagcatgatcatagttcactgcaaactcaacctctgaggtgggagaattgctggaacccaggaggcggaagttgcagtgagctgagaatgtgtcactgcactccagcctgggcaagagagcaaaaactccatctaat

SEQ ID NO: 50494 - DNA, 467 bp, Homo sapiens
aaagagaagagccattcctaggagagatggaatacatggctgttttcctcctagggtatggctaagaggagcaaacccaccatagatgaggataaggagaaaatagctgaatttcctacaaacttttgaaggccacatgtaggctggccataaggagccctaattatagagcaaataagtacccacctacccctaaatcgttctcatgaggccttcactgagtacacagtggcagcaagctgatggctaagggcaggacagaaatctgagaaagatccctgcccccacccaatgtacacaggaccttcactgattatacagcagcagtacagtacagtacagtggaacctgagaacagggcaggagggtagagaaagaccccctccaaagcacaaaaatccttcattgaatgcacagaagtggctcaccaagagtgcagagaactccacagcagcccaaagctggca

SEQ ID NO: 50495 - DNA, 1019 bp, Homo sapiens
cacacaaaactctctacactgctagtctttaattctcaaaaacagttccctgagagagggaacataattgcctctattttacagatgacaaaaccaggcttagaagttacacaaattgccttgcacagtggctcacacctataatcccacacattgggaggctgaggcaggaggattgagttagaaaccagcctggtcaacatagcaagacccccatctctacaaaagaaaagataaatttgctgggcatagtggtgcacacctatactcctgcttgggaggctgaggcaggaggatcgcttgagcccgggaggtcgaggctacagtgatccatgatcgcaccattgcactccagcctgggcgacagagcgaggccctatcgcttagaaaacaaaaagttacatgaagttcccccaaggtcccgtagctagcatgtgatgtggcagggagagagcctgtccgcttcactctctcacatgggaccagaaaggggtgatgctgtgcgtggacaggacatctggcaagtggtgtgtccaggacacaggaagcagcgtagtggccaagctgcctccagctgtcacatctgtgtgtctctgcagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtgactggctgagggatcctctagaacagct

SEQ ID NO: 50496 - DNA, 583 bp, Homo sapiens
agcgggtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaaggcttgagaactcctgtgtgaattaaatcacgaccttctgatgaagccactccgatgagcctgtgaggcacattgtcttcacactgtgctggggcagggttgttggcaaacccccatggatggcagccggcaatggcctcacagtgacaaatgcgtctgccttttgacccagaattctacccctgagagtgcgtcctacagatgcttgcaagtggtatggtaatggatgtacaaagctattcacagcaggggtgtttgtggtagcatggcctgggagacagcccagatggctttcagcaaaggattggtggcaggtctgcagccctggggcttatcagacaccaaccctgctggcaccttgatcttggacttccagtttgcagaactgtgagaaaataaaatttccattaagtttc

SEQ ID NO: 50497 - DNA, 858 bp, Homo sapiens
agcgggtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattcacgagtcctgggttttccagggctcccggcgcccggtagggtgagcgcttgagagcccgggggccttattggattcccagggtggcccttc

SEQ ID NO: 50498 - DNA, 677 bp, Homo sapiens
agcgggtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggtgagtcgggggatgtggatggtggactgcaagagagattccactttccctgggggactcctcctccagggctgccgcaaccaaactgccacaagctgggcactccttgcagggctgtgtctcacagcgctggagaacggaagtctcaagtcaaatgtgggcagggttcctagggagggtccttcctgccttctccagcttctggtggccttagacagcccttagcttgtgtctgcatagctccagcctctgcctccattcacatgtgatcctggtgttcctgggtctcaaatcttcctctctctttttttttttttttttttttttttgagacagagtctcactctaacccaga

SEQ ID NO: 50499 - DNA, 430 bp, Homo sapiens
agcgggtagacgccatgatggatgtgtctggtgtgggtttcccaagcaaggttccttggaagaagatgtctgcagaggtaggtggattgcagggagggactaaggggctggggcggagttagctcatttattagtttggaattccaagaaggaagcttttagaagccgtctagagcactcctgtgggcatgcagagcgcctagtgcgtgccaggtccccagtgcttgagcaccatggtgtattttaccttctcctaaggatttttgttaacctggttttcaggataaagaaaattgaagtcctgactatgctaataatatccgtagaccctgccaggcgtggcggctcacacctgtaatcctagcacttttggcggatcacgaggtcaggagttcgagaccagcctggccaacatggtgaaaccccgttt

SEQ ID NO: 50500 - DNA, 1837 bp, Homo sapiens
cacacaaaactctctacactgctagtctttaattctcaaaaacagttccctgagagagggaacataattgcctctattttacagatgacaaaaccaggcttagaagttacacaaattgccttgcacagtggctcacacctataatcccacacattgggaggctgaggcaggaggattgagttagaaaccagcctggtcaacatagcaagacccccatctctacaaaagaaaagataaatttgctgggcatagtggtgcacacctatactcctgcttgggaggctgaggcaggaggatcgcttgagcccgggaggtcgaggctacagtgatccatgatcgcaccattgcactccagcctgggcgacagagcgaggccctatcgcttagaaaacaaaaagttacatgaagttcccccaaggtcccgtagctagcatgtgatgtggcagggagagagcctgtccgcttcactctctcacatgggaccagaaaggggtgatgctgtgcgtggacaggacatctggcaagtggtgtgtccaggacacaggaagcagcgtagtggccaagctgcctccagctgtcacatctgtgtgtctctgcagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctgacccctcccaggggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgccactgcactccagcctgggtgacagagtaagactccatctca

SEQ ID NO: 50501 - DNA, 2152 bp, Homo sapiens
gctgtgggagtggtgcccatgatggcattaactgaattcgtttgggggacctcatctccccttaaggctgccagctggctaaaggcacagcggtcgctggtatacctctagaccatggatctgagggcatcttggagaccctgggatactggggcgagggcttctaaggcagagaggagcagccgggcatgggcgagggggaggggcacactctgttgagaaggaaagtcttacggagcctcatgtttgtgccctgcaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctgacccctcccaggggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50502 - DNA, 1970 bp, Homo sapiens
agcgggtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctgacccctcccaggggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50503 - DNA, 1299 bp, Homo sapiens
agcgggtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggctttttcctggtgagtggggtctttgacctggagcccatcgtgtatacttcacagaacgttgctctccagctgaccctaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50504 - DNA, 1402 bp, Homo sapiens
gctgtgggagtggtgcccatgatggcattaactgaattcgtttgggggacctcatctccccttaaggctgccagctggctaaaggcacagcggtcgctggtatacctctagaccatggatctgagggcatcttggagaccctgggatactggggcgagggcttctaaggcagagaggagcagccgggcatgggcgagggggaggggcacactctgttgagaaggaaagtcttacggagcctcatgtttgtgccctgcaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50505 - DNA, 887 bp, Homo sapiens
gctgtgggagtggtgcccatgatggcattaactgaattcgtttgggggacctcatctccccttaaggctgccagctggctaaaggcacagcggtcgctggtatacctctagaccatggatctgagggcatcttggagaccctgggatactggggcgagggcttctaaggcagagaggagcagccgggcatgggcgagggggaggggcacactctgttgagaaggaaagtcttacggagcctcatgtttgtgccctgcaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgccactgcactccagcctgggtgacagagtaagactccatctca

SEQ ID NO: 50506 - DNA, 659 bp, Homo sapiens
agcgggtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttctttttttttttttttttttttttttgggaggggggggttcccctttcccccggggcccaaccctgggggtgccccacatgagagatctcctttctccaaagaaaatgcatcatctcactccctcaaca

SEQ ID NO: 50507 - DNA, 2247 bp, Homo sapiens
cacacaaaactctctacactgctagtctttaattctcaaaaacagttccctgagagagggaacataattgcctctattttacagatgacaaaaccaggcttagaagttacacaaattgccttgcacagtggctcacacctataatcccacacattgggaggctgaggcaggaggattgagttagaaaccagcctggtcaacatagcaagacccccatctctacaaaagaaaagataaatttgctgggcatagtggtgcacacctatactcctgcttgggaggctgaggcaggaggatcgcttgagcccgggaggtcgaggctacagtgatccatgatcgcaccattgcactccagcctgggcgacagagcgaggccctatcgcttagaaaacaaaaagttacatgaagttcccccaaggtcccgtagctagcatgtgatgtggcagggagagagcctgtccgcttcactctctcacatgggaccagaaaggggtgatgctgtgcgtggacaggacatctggcaagtggtgtgtccaggacacaggaagcagcgtagtggccaagctgcctccagctgtcacatctgtgtgtctctgcagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctgacccctcccaggggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50508 - DNA, 1372 bp, Homo sapiens
cacacaaaactctctacactgctagtctttaattctcaaaaacagttccctgagagagggaacataattgcctctattttacagatgacaaaaccaggcttagaagttacacaaattgccttgcacagtggctcacacctataatcccacacattgggaggctgaggcaggaggattgagttagaaaccagcctggtcaacatagcaagacccccatctctacaaaagaaaagataaatttgctgggcatagtggtgcacacctatactcctgcttgggaggctgaggcaggaggatcgcttgagcccgggaggtcgaggctacagtgatccatgatcgcaccattgcactccagcctgggcgacagagcgaggccctatcgcttagaaaacaaaaagttacatgaagttcccccaaggtcccgtagctagcatgtgatgtggcagggagagagcctgtccgcttcactctctcacatgggaccagaaaggggtgatgctgtgcgtggacaggacatctggcaagtggtgtgtccaggacacaggaagcagcgtagtggccaagctgcctccagctgtcacatctgtgtgtctctgcagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctgacccctcccaggggaatttacctgtgtggacactcagccggggcccacctggctgccatgatgctcctggccgactggaccaagcatggggtcacgcccaacctcagaggtttccatgggagctacagcctggctgggcaaccttcatctccccatgagccttggggtttgggccaactgcttgaaatcctcccggccatgagtggcttgaccgcagggcttcgagccctctgagcaaggccttctctgcctcctctgtgccccttcccctggtcctgcccctctggcggtgggggtgggctggccctgccttgctccgcctggagcctggccctgtgacaattctg

SEQ ID NO: 50509 - DNA, 1617 bp, Homo sapiens
gctgtgggagtggtgcccatgatggcattaactgaattcgtttgggggacctcatctccccttaaggctgccagctggctaaaggcacagcggtcgctggtatacctctagaccatggatctgagggcatcttggagaccctgggatactggggcgagggcttctaaggcagagaggagcagccgggcatgggcgagggggaggggcacactctgttgagaaggaaagtcttacggagcctcatgtttgtgccctgcaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50510 - DNA, 995 bp, Homo sapiens
tgactgataaagccctataagacctacacacagattggaattgaagcctgcagtgctacctgttctaacacgggacgcatacgtggcagagcggaagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggcttactggaacctccaccttccgggttcaagctatttttcttgttcagccttctgagcctttgggactggtggtgcctgccattatgcctgggtaatttttgtatttttaggagagacggggtttcaacatattggccaggctggtctcaaactcctaaccttgcgattcgcccgccttggcctcccaaagtgctgggattccaggcgtgagcccctgcgcccggccagtatggcattatttttaaatagttcataaagaagcacaaaagaatattatttcataacatgtaaaaattatataaaacgtaaatttccatgttgataaataaagttgtattggaacacggc

SEQ ID NO: 50511 - DNA, 799 bp, Homo sapiens
cagtggcatgacctcagctcactgcaacctctgcctcctgggttcaagcgattctcctgcctcagcctcttgagtagttagtagagacggggtttcaccatgttggccaggctggtgtcgaactcctgacctcaggtgatctgcccgccttggcctcccaaagtgctaattagaaaggagaaggcattcctattctgtttgagagcccattctgaagttgtacacatcactctgctcacattccattggttagaatttaacccgggcatggtgactcatgcctgtaatcccagcactttgggaggccaaggtgggaggattgcttgagctcaggagttcaagaccagcctgggcaacatagtgagactctgtctctacaaaaaaaaagtaaaaacaagctgaacatggtggcatgcatctgtagtcccagctcctcaggaggctggggtgggaggatcacttgagtccaggaggtcatggctgcagtttggtgtgattgagttactgcactccagtgtaggtgacagagcaagaccctgtctcaaaaaaaaaaaaaaaaaaaaaaaagaatttagtcacatgataacacctagctgcaaggatttctagaaaaggagtctattctaggaagtcatgtgctcatccaaaaatttggaagagaggttctttcacaaagactaatgggagaacagatactggggagacaactagcaatctctgacatctcatcagtgagtacataaacactggtaactgtcaaccagatatatacctttaactctattcttccgtcatatca

SEQ ID NO: 50512 - DNA, 421 bp, Homo sapiens
gtttttaacgttagtccatgttgttgtggagctatcgtctttcttttattgctcccttgatttaggagttagccacaactaacccctctgtctcttttatctccctatgtttctggtattggatcatatgattcttcagaaccatgcctacacagttgtccccctttcccagtattgaacttggagataggaggcagtgggtaagtctggtgggtgaactggcttggaaaaagtgctcaagtgacttctttctgagaggaaacttgagactagtcttttctacatcatcttacttaatggggctaataattaatgtagtccgcatgaatagttcccaaccaaatgtttttcaaagccaatcaggttggtcttaatatctaaagatgtcatccagatgtgtaaaaataatgcatgtataata

SEQ ID NO: 50513 - DNA, 2394 bp, Homo sapiens
  misc_feature (856)..(856): n is a, c, g, or t
atgtaccgctacctggccaaagcgctgctgccgtcccgggccgggcccgctgccctgggctccgcggccaaccactcggccgcgttgctgggccggggccgcggacagcccgccgccgcctcgcagccggggctcgcattggccgcccggcgccactacagcgagttggtggccgaccgcgaggacgaccccaacttcttcaagatggtggagggcttcttcgatcgcggcgccagcatcgtggaggacaagttggtgaaggacctgaggacccaggaaagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatnaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcacttaacaagcctaaccttgactcagtgaatgcctataaaaataataaatgaaaaaaaacagtatttttatatcataaaagtttcatttgtagcttatcattcacgtattgttgtccagcaaacattaaaagccctgtggat

SEQ ID NO: 50514 - DNA, 486 bp, Homo sapiens
agaccatacaattcactcatttaaatgaactacccatttaatagtttttagtatgttcatagatactggcaaccatcaccacagtcagttttagagcattttaatagtcttactaacaaccttcacccagtaccctttaaatatcacctctctactccctcatccgcccagtactatgcaaccatcaatctgtctctatggtggtagattgatactgccacctatagccatttgcatcattgtatattctattcagattctgttagtcaatttagataagaccaaggaataatgagacaataggattccctttaaaaattgcttggaggccaggtgtgatggcctgtgcctgtagttacagctacttggaaggctgaggtagggaaaatcacttgagtccaggagttcgaggctgcagtgagctatggtcacacctatgaataaccactgcactccagtcagggaaacatagtgagaccccatctc

SEQ ID NO: 50515 - DNA, 347 bp, Homo sapiens
ctttgtgtttgagaagcagggtcttgctttgttgcccaggatgaagtacagtggcatgatgatcatggctcaatgctgccttaaacttctgggctcaagtgatcccctgccatagcctccaaaagtgctgacttaacttattgaacccccaatttccctatttgtaaaatggagataatgagagtacctacctgtcaatgagaatgattttggctgagagttcagaaaactcaacacaaatggcttaaatctgaaggaaaataacattacctcgtttagtaggaaagggttcctaggttgtctaatatagttgcttacctagatcccccaaaataaaggactcattc

SEQ ID NO: 50516 - DNA, 279 bp, Homo sapiens
ctggatctgaagaaaaggtggagaaatcagcgccacctctttctcctgggttctccatcactcttgactgtgtggccatggttctccactgacttctaactcatacccacccccacagactcatcaacttccaaaacgtcaccctgcatcctgccctcctctcagtcctcactggatccccctggtcagctcaggcctctcgcctggaccaccacagtggccccctaatgggtcagatgcctccacaccagccaagagcaatgggtctaactgtgcagg

SEQ ID NO: 50517 - DNA, 446 bp, Homo sapiens
tcctgtggtgtaaaaggctttttaacatgttctgtggtgaggaagggaagctaatagggccttgtgggcggggcctttttggtgattcaatgtaaagtggcttctaaatctaaatgtacaatggaattgatgtgttgtatgcccacacttacctgtctgatgattgtcagtgggattctccctttcaagggctcccacatgtacagaggtaataatggactgtgtaaattgctccccaacgtgtctctgacccctcctggtggtcctccagacacaatacaaaatcccaggaggagaaagggaaattgctgactgacttaattgcactcagagcactcaagccttttccaacccagtgtggccacctacctgacgcaaccaccaaacagcatccactttgaaaaacaggcagctattaatgtgcatctctcgaaactgaataccta

SEQ ID NO: 50518 - DNA, 286 bp, Homo sapiens
ccaggcttagagagtgctcagtttatattgttgaatgcatgaatgtggaatcaaagggagagtgtggatgctgggtttggcagagttggatttgagcctgtttttagtattgactggctgtgggtagctgtgagcccgaccatgtctttttggtggaaagggatgataaccccaacttctcctggttgctagaacattcagtgaggtcatatgtcttcatcaatgcctgtttccccattcccttgccttttctttaaggtttgtatggaaaacagtgagaccccag

SEQ ID NO: 50519 - DNA, 511 bp, Homo sapiens
ctacttgctgtttttccttaagtttttgaaacctgactatacttggagtcttgggaacacatcttacagtgtttcctcacactgtgagataaaatggctactttttcttgaagtttttgtcttctaaaatgaacaattcaaatatagttataaaatggagtatttattttgtacttttaaaaaatggtttaaggtgaggctttgtttattcctaatatgtgaataatactgatgtgaaaaatgtgagtcccagcactttgggaggccagggcgggcggatcacgaggtcaggagatcgagaccatcgtggctaacacggtgaaaccccatctctactaaaaatacaaaaaattagccaggcgtggtggcgggcccctgtagtcccagctacttgggaggctgaggcaggagaatggcgtgaacccagaaggcggagcttgcagtgagccgagatcagatcacgacactgcactccagcctgggcgacagagcgagactctgtctcaaaaaa

SEQ ID NO: 50520 - DNA, 354 bp, Homo sapiens
ggactattgctaactaacccatgggactcccactaccttcatgaggctcggatgaggtgaagggtccctaaaatcgtgccaactagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcctgggtcccgcgccatcatctcttcgaatgacctccctgctattcctg

SEQ ID NO: 50521 - DNA, 500 bp, Homo sapiens
atctagagatgaaattatgcctctaatattttatgacctgccaattttcattcagggttactgttttttttttcacgttatagtctaagatttattattaaacaatgaaacaggttaacactaccatttggctttaatgtttgactaccgaaaagctaaccattcatcaaatttgttttttaattgtggttccctgggtcactcacacatatacatcgaaacaatttattagtgtaaagattaattgtggtaattttattgtcttgggattagatgaagagaccttcaaaaactccttttgatgaaacaagtaataaaatgtaggaaacagcgagttctgtggttcaatatttatatgtctgtgctaggaagctttacataaatttggaaaactttttgtagggtatttggcagagtggaaaatttgccaatacttcaggcacacttataagcccctcttgtcttcagtctggttggctacgtccaataaagtttgattt

SEQ ID NO: 50522 - DNA, 468 bp, Homo sapiens
agtgtgtggaaaatttccccccaactcacagtttctacagtggaaaaagtgagactgaggtgaacaaccagcttctccacaatcttgagttttctggtgagaaatctttccctgcctcaatgcacaagaagtgttgagagtaccagaagggagaatatccctgaggaaagccagagacaaagtggtgaggtagaaataccatccttatctctggaaactctgctctatatcttggccaaaggagacgccaaatcaaagtggctgtttagcagcaccacacagtaagagtttcatctcacaggtcccctgggtaaaaacccctggctggccttcccacactactgggatatcctctttgggacctctcccattcaggatgggtggcactctgatcatttactaaaaccagtgctaacctgggcttaaggcaccaaccatctagtactgaaaaggaggcagtgacctaga

SEQ ID NO: 50523 - DNA, 726 bp, Homo sapiens
ttttgagttggccaagtacatacacattaaacagtcctttactagagatgctggccctccatttccatccatttcagaattcaccagggagccagagatccaggatggctcattcgtctcacttttgaccgccctgcttctctagttttctctttccctcccgcttagactgctaattgtcttcttcccctcaccagtgaccccacagctccgtggttccttcggcccagatgccacaacctgctggcataatcttttccggttggcccacggagtataatcttaaaatttgatttcatttccaggcattaaaaatcaagagatttcacatggttacatttctgggttccctctaaaaatggaaagatctggaagtaaagaacccatgttccctcatagcaatcattatctgatactggagtagcagctgtcccctttcaatggggtctgctctttttgtttcaccacagtcctcatgactctctgttgcacactcatgccaaagtaaaggtgccctttcctatgaactttgtaacactgtggccttttcttcacacccagcccacgtccctcatatatatcacctgcctgccccagtaggtctatgagtttgaaactggtttgtcagtccttaagctttatcagcttcatccatttctcagggagtaaagaagaaaagagggaaagcgcctaagtagtgatcttccctctgtgtgttagctgaaa

SEQ ID NO: 50524 - DNA, 920 bp, Homo sapiens
aagcagtggtatcaacgcagagtgcccattacggccggggaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggc

SEQ ID NO: 50525 - DNA, 433 bp, Homo sapiens
  misc_feature (31)..(31): n is a, c, g, or t
gggggggggggggggggcatctttgtggtgnaagttctctgctacactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggc

SEQ ID NO: 50526 - DNA, 416 bp, Homo sapiens
gtgtggtggattcccggctcgagccggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggc

SEQ ID NO: 50527 - DNA, 898 bp, Homo sapiens
gggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggc

SEQ ID NO: 50528 - DNA, 1027 bp, Homo sapiens
gggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggtaggcacccactccctcctgaacccgctgctgccacctgcccacactccaccagctgcagtgctcacttgacatcctgctgcctccgtctccctcctcctctgtaatctgcactgcctttgctctcaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggc

SEQ ID NO: 50529 - DNA, 893 bp, Homo sapiens
aagcagtggtatcaacgcagagtgcccattacggccggggaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggtacaggatttctccatgttgcccaggctggatatgaactcgtgactcatgggctcaagcaatcctcctgccttggcctctcaaagtgctgggattacaggtgtgagccaccgcacctggctgccacttggttgttttaaacctgaactcagtggtggctcacacttgactaccaagtgtgatatgtcagaaattcct

SEQ ID NO: 50530 - DNA, 585 bp, Homo sapiens
  misc_feature (579)..(579): n is a, c, g, or t
gggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggcttgttcaggaaggacgnaagttg

SEQ ID NO: 50531 - DNA, 694 bp, Homo sapiens
tgccttgcaatactgaacatattgtctcatggtattcgccgtttgaacctctcatgtggactgcgtgtccacccacatctgccatcttatacagggggcccacttatttaatgtaaattcactagaactctgtgtatattaaagagattatgaatcgtatttaaaagatgggacatgtggaggaatagttgtctaagttgtagaaaaccacatcagctaaaatgtcttggtgggagttagtgtgatcatagcagagagggagatgggaactagattttcagaagcagagagctggaaactcacgatggaaaaagctggaggggtaggttaggttcaggttagagagccactgaatgctaggtttggaggcttgttttgggataagaaaatagatacataagatcaagcaatttgcccaaagccatctggggagctttggaaagccctgaaaagcagagaaacttaattttgccggagtagttattgagttctcaattaatttaaatggtgaggaactgctcacctaaagccttgaaatgccgatgaatgcttataagaaaatcctgccaatatcctgcttctaacatatcaaccttggtgggctccagccagccctacacttgattcccataagataccccaaaagataaatgagtatgttaattaattccattcatagccttccccactaatc

SEQ ID NO: 50532 - DNA, 429 bp, Homo sapiens
gttaacagacagtgagtgaaaaaataaatatatattttgtcaggcagtgacagatgctatgaagaaaaggacagcagattcagaagatggtgaatgatgaaagtgacgcatgccacttagaggaagtgatcacaaaacgcagcctgatcggatggcatttgaggacagctctaacagaagtgaaaaagcaagctatatagacttctggaaaaagatcatttcaaacagatataatagtaagtgtaaaggctctgaggcagaaagttcttgatagagacaacaacaaaaaaagaaaacagcaggaagtttttcacttgtaaggttagttttgcctggatcttcttctctatttagaccttactggtcctttaaagtatctctcaagtgaaatcccttaaaagaagaaatgcctggtatctctccaaaaag

SEQ ID NO: 50533 - DNA, 454 bp, Homo sapiens
tccacatttcttgaaataagcttgtaccacatttggaactggtattgtggtgggagagaattgggcatttgtgaaagatacttgggtagagtctcccaaggaggtactatatgaacggctggtatgttatccagctcatcatacaaccagttactcgtgggctagtcactacagaatacacagcagaaataaaagacccattttaaaggagaggctgacacaaaagcttgcaggtgttttttcttgtctgtgaatggtcactgcactccagcctggccaacatagcttgactccatctctaaatacacacacacacacacacagacacacatgagttttcctcatgtgaattgatttttttaataatataacttatttcaatctgtatgttttaaaaattgaatgctgaaaattatgttacccacccagagataagtattttaacattttggat

SEQ ID NO: 50534 - DNA, 314 bp, Homo sapiens
  misc_feature (3)..(3): n is a, c, g, or t
  misc_feature (309)..(309): n is a, c, g, or t
ctnctctcacacatatactacagatttggtctgaagaaaggcttaagaaagccatcttctcttagcattggggaaaaacaaaaataaagaattgtttagttgtctagaactctattaaatttgccatgatgtatatgaaaccccgactgagttgctgtcttggcatgatgtcagagagctaaaggagccatggtgatggtacttagactctcaatgctcacacagtcccctctcactttttttaaggctgaaaagatgaaaacaagggaaatggtgcaaagacactaaaattctccatctgcaaaaaanaaaaa

SEQ ID NO: 50535 - DNA, 584 bp, Homo sapiens
gtctgcaccgtctcttttatgcagagcattaggagaggtacatactggaaaagcggcgagcttcacccccaggtgcaggagggcacttgcaggatgggttccggaggaaatgttcagcctccattttgtgattgtctcagtgatggacacagacgatgacgttttggctccataccacgagtgttcgctacaatttgctgcccgtgtcaccagagccagttgctaacacatcagcatttgccactgttcatcctgactgccctgtcagatgtgaggatgttctttcattgcttagtattctggcagaggactttgaaagactcatgtaggccagtgtgcccccgccttccctggggtctggaggtggaattccaagcggtgtttgggcgtgtgtgtgaggacacggggtgggggcagctgtcacagtagtagccggtcttcacagcatgttaaattttttctgttcctaggaatccatattcaggtgtacagtgctttctgcacagacggtggtgtaggaaacacgagaatttcctatagctaaaaatcccaaatgttgcagaggtattgcagctatttctctt

SEQ ID NO: 50536 - DNA, 466 bp, Homo sapiens
gctgagaaaccagcccacaattacacaaagacaaaaaaagggggacccaggtcttctgtaaccacctcataggtctccctggtgccacctgcagcatttctagataccgacaataagggtctccctatccccaactttcagaggtacatagtggaatttcttggcattatttgctgagggtaggaaagtcctaggcaatggagtccagattttagtaagtcagaccccatgtgtgagaaggaaagctggaatcatgggtggtaatccccactttgctgccctgagcgggacctgtgccatttaaaccttggaacgcaactagtgaacaagcgcctatgcagtgcttataacagagttggtgtttccactctaaaattaccacctcttcttatcaaaatttgcaactttcttcccgtgaaaataggcttacagttccttaactggagcaatgatataaaagctacag

SEQ ID NO: 50537 - DNA, 306 bp, Homo sapiens
ccctgcctggccaataagagtgtggtcctggattgagcccttgaactttcacccaatgaggtggtgattggctaaggcaatggtgtcaccggcttcatccccaccagatatcctcagtgtgtatgtggtagtttctcaatcggaagtatgaaaatcaggaacattgcgaaagggagggcaagagctctgagcgattaatatcctgtgaagtgtgagagggaaacttgagctttttactttgcagtaacaaccttggaatggaaagctatttcggtagccaagtgtggaaagtgaacattaaccaaa

SEQ ID NO: 50538 - DNA, 1198 bp, Homo sapiens
  misc_feature (604)..(604): n is a, c, g, or t
  misc_feature (667)..(667): n is a, c, g, or t
  misc_feature (672)..(672): n is a, c, g, or t
agaacccagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccncctcgtccgggaaagccagaaggaccacccccacaaggaggaaaccagtcccaaggtcccccncctcntccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggatcaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagctctacctttaatataccaataaaataaacagcttacaatttctg

SEQ ID NO: 50539 - DNA, 1239 bp, Homo sapiens
  misc_feature (604)..(604): n is a, c, g, or t
  misc_feature (667)..(667): n is a, c, g, or t
  misc_feature (672)..(672): n is a, c, g, or t
agaacccagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccncctcgtccgggaaagccagaaggaccacccccacaaggaggaaaccagtcccaaggtcccccncctcntccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggatcaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagcattgggagatatacctaatgctagatgatgagttagtgggtgcagcacaccagcagtgcacatgtatacatgatctactggatcc

SEQ ID NO: 50540 - DNA, 634 bp, Homo sapiens
agaccccagaacttggtgtctgcctcccatggcaccgggaagggtggaggcaggttagaaaaatatcccctttctcccacagccatcagagcaggactctggctcacaggtgcctttagaagtaccatttcatgtgaaggctacaatgccccattttacaggtggggaaacaaaggccttgagggctagggaagagggcagcctccccaggtggggcaacgcaccagctcctcgaagccgctgtggggctcggcccgctgcttgtagagggcttcccaccccaactccagcatcctctccagctcccgtagagtctcctgctgccacagcctctcatcctgctcccgaaaacctctcctgttccagcagctcctccaccttgtccagcagcctctcctgttcctcctgccacccctcctgttcctgcagcctctcctcctgtctcctgttcaggagactcaacatctgattgttttccacctcagcctggagctgtcttcccacactctccagctccttccttaggtggttggtctcatcttggagctgctccaccttagagggccctgctgggggctctggggccaggggttcagctgagaaaggaagcagacaataagggcctctggataaa

SEQ ID NO: 50541 - DNA, 289 bp, Homo sapiens
atggccatgctcccgccaaggtctctggaaaaaaattcccctttgcctcttcctacttctggtggttaccagcaatttttggcattccttggcttgtagctgtgtcacttcaatttatgcttgtgtcttcacatggctgtcttctctctgtgtgtgtctgtgtctttttctctgaatccgcctctcctttcacttataaaaatcctggtcattgaatttagggtctaccctgatgcagtatgacctcatctttatttgattatttctacaacaccctataccaagtaat

SEQ ID NO: 50542 - DNA, 621 bp, Homo sapiens
aagccacaaagcctccccgagccaccacagccccaacctgggccccctctgccagggccctctcctctttgctccagccacacgtgccttccttggtgcggacaagcctgctcctgcactggggttttgtctgttccttctgtgccttccatccacgacgctgacaccagcctacaccctccaggccccactcagacgttactcctcagaaagacccctggcaacagccccagctggaccagctctcctcccgccactctgcagctggcaggagccatagctgtctcactgggggtggtaacccagtgtcccacacacctgcctcccattgggccctcatacaacatgttagacaacatgtgctgaggctaccgagagagggcaccaagtcacagttggaaaaatgtgccccctgccaacccttcccagaggtttctcagccaaagctatggagtctccacggcccctgcagcacagaagtgcccgagcagtggagcaggctcagcccctgcctggtgtgtgctggtgtgcatcccgagatagctgaggaggaggctgccgaggccactggctcacctcgggcaaccgcaggactttgcagtacttcactccgttccgcag

SEQ ID NO: 50543 - DNA, 420 bp, Homo sapiens
acttattcattactacaaattccccaccacgcagaaaagagaaactgatattttggcacatctctaaatcaccaatttatctaccaaaatttcttctaaaaatgcattcagttctctgcagccatagaggaagagaaatgtttcctactttttttaacccagtaatattcccataactaggccctgaggttctgtttgaaaccactcccaaaatatacagatctgaaaaacttattacacgtgtcaagggaaaacgaaagaatttttaacaaatataccattagacattttttaagtttacatatttatgcctctttgagaatattctcctatctttcaaactctaccaataaaatgcattgtacagttaataaaatggaagttgaaataaataaacatttttttcaagatgacaaaccc

SEQ ID NO: 50544 - DNA, 379 bp, Homo sapiens
ctctatcttcttatcagatttgttaacaatgtctactttttttgttacaaatttataattattataacttggactgggaggttctctgggctgcaccctcatcagtggggggccctcctcgcacactcacagtttgcaggactccgaactgggcccgcgagatctccacctgcgcaaaacgaaagggcggattctccttggactcacgaggcaaccgctccccggggtgagaacgggggactcattcctccggcactgggagaagacgattctttaggaggaggacagggaagcgaatgctacccaggtgcgtaatcacatttgggcaccctcgggggcctgagaggaggccaggggtgacctgcccccattctcacag

SEQ ID NO: 50545 - DNA, 352 bp, Homo sapiens
ccggggccgcgacgcgtctctccagcccgggatccggggagctgggctgtccccagaccgacgggacagcggcatctcctccacctgaaaaggaaagaggaccagtttgcaggactccgaactgggcccgcgagatctccacctgcgcaaaacgaaagggcggattctccttggactcacgaggcaaccgctccccggggtgagaacgggggactcattcctccggcactgggagaagacgattctttaggaggaggacagggaagcgaatgctacccaggtgcgtaatcacatttgggcaccctcgggggcctgagaggaggccaggggtgacctgcccccattctcacag

SEQ ID NO: 50546 - DNA, 103 bp, Homo sapiens
  misc_feature (3)..(5): n is a, c, g, or t
  misc_feature (53)..(53): n is a, c, g, or t
  misc_feature (76)..(76): n is a, c, g, or t
ttnnngaagaaacactgtttcgcaaagttactttgagactatatggtcttttnaagtttggtagcatttccctgtnaaactatctggggattgatactttttg

SEQ ID NO: 50547 - DNA, 374 bp, Homo sapiens
ttgttttatagttatactgttcataaatcatttttccccatttgtgatcaccaagaatggttaaaacaaagctttggtctaaattagcatgcaattgctagacatttttctttcctcttgtggggagactggaaaatatttttgaagtatatatgggtagctacactttgtctgctccaacattagactaggtctagggtgaagtgcagtaaactgcttcccaaggcagagtgaggcttttagaataggaagtcaacatggctcagcaagtaattcacatgcaaatgaacctgcctggaacattttagttagaaaaaaatatgtaattagcagactggaatgtatccaggatcctagattcggttaccacatat

SEQ ID NO: 50548 - DNA, 297 bp, Homo sapiens
gatcattcgcacagcagctccaggtctcccctcgaggcccctggaggaaggaggcacagtacattggatctgtggatgagcagatacattgatgagtggtgcttcagcaagatgacagatctcccagggcagctgaaaacattcaagtgctgaaaaattaaggcatctttttccttgatacttgcaaaacagtttattcatcatattgtttttacttttactaattcctctgaccatgagtgacaggtttatgccattggatgagtgatattgcatcccagagcccagagtccactg

SEQ ID NO: 50549 - DNA, 412 bp, Homo sapiens
acatttgcatattaaaatacacattatgttgttgttgtcagcctttctggaaattacgtttatataggacatatctgtgaattttgtttcaggatggtaaaggaggtggtgttacatttctgtactgctggtgcattgagagacccaagcaagtatcaggcttttcatccgtggaacacatgctccagaaccttctagctgttcacttgtgatggatactctgttagccttcactattgaatgcacttttaaaaatgatcaaaaccaacatttcccacagtatgaaatgtttgcaaaaaaggtatgttgggtttgttagggctagaaattgttattctaagtaaagaaacctggagaattttcctaagccagctaaatttattcgacaacagtacagttttatttgatgcct

SEQ ID NO: 50550 - DNA, 719 bp, Homo sapiens
  misc_feature (549)..(549): n is a, c, g, or t
tggcagactgcaactttgtattacaagctcttatctccatttccacaatgaccaggcagcatctttcaaaagaaataaaaacctaagaaacttcattgatctgtccttttgcaggtggcggtgagggcggacaggacgccatgaaggcctcaggcacactatgagagtacaaggtggtgggtcgctgcctgcccacccccaaatgccatacactacccctctaccacatgcgaatctttgcacctaatcatgtcgtcgccaagtcctgcttttggtacttggtatctcagttaaagaagatgaagaagtcttcaggagagattgctactgtgggcaggtgtttgagaagtgcccctgcgggtgaagaacttcggcatctggctgcactgtgacgcccagagcagcacccacaacatgtgccgggaatatggggacctgaaccaccgcgggtgctgtcacccagtgctaccaagacatgggcgcctggcaccacgcccgggcccactccgtccagatcatgaaggtggaggagaccacagccagcaagtnccgcgccagccgtcaagcagttccatgactccaagatcaaattcctgctgccccactaggtactgcactatccgcacaagccacacttcaccaagaggcccaacaccttcttctaaggcagggccctcacccgggtgtgccccaaataaactcaggaatgccccagtgga

SEQ ID NO: 50551 - DNA, 111 bp, Homo sapiens
catatcaagtaagggggagagttgaggtccccattgagtacaactagtaggtcctagagctgcattagggttcctgtggtgtgctataagctctatgctactgaggctgaa

SEQ ID NO: 50552 - DNA, 403 bp, Homo sapiens
ggctggcgaaggaataaagacatgctcctatctttaaggacatgtcccaaacgttgctcagatcactagccagatctgattgaatccaagtgaggctgggaaagtaatccttatattctgggtggccttgcacttatctgaaaatcagagttctaaaagggaggatgaatattgagagaccatagcctctgccagtgtgcttaatgagtatgccaagaataaaaagtagaacttaaatcccttcatcttccccttcattcaagtgtatattctgctagcaaagtgagacattcatctgtacttttcttgatacttgaagtattttgttagaaccagagtaacaaatccccatggacccaccatccagaatttaacaaatgcttacatcttccttcagatcttt

SEQ ID NO: 50553 - DNA, 258 bp, Homo sapiens
actacttcccagggtctccctagacaagttcggccctcccctgaccccctagtctcttaagcctctcctctggactcatggctgccccctcaggctgggaggactctgaggaaagttacttcccaaagtgtacatattttatcacactaaatcaggccacaggggaagtctctcagcctactctggctcaggaggctgcccaatagaaaacaaacaaacaaaccaataaataagtaataaatcaggccacatggcaac

SEQ ID NO: 50554 - DNA, 430 bp, Homo sapiens
ccagttttattaagaaggtatttaaggccaggtgcagtggctcacatctgtaaaccccccactttgggaggcaggaggattgcttgagtccagaaactcaagaccagattgggtaacatagagagaccctctctctacaaagaattagttgggtgtggtggcacacacctgtagtcctagctacttaggaggctgagtgggaggatcgattgaacacaggaattagaggctgcagtgcagctatgattgcaccactgtcctccagcctgggtgacagagaaagactgtctaaaaataaaataaaataaaataaaataaaaaaggtatttaagacttctaggaagagactagctgattaattcaaattaggtactctccaataaagcatttgaatttgtatgatgagttcagagtctttaaaaacttaaaa

SEQ ID NO: 50555 - DNA, 279 bp, Homo sapiens
gtgagcctgtaatcccagctactggggaggctgaggcaggagaatcgagtgaatccaggaggcagaggtttcagtgagccaagactgtgccattgcactccagcccgggtgacagtacgagaccccatatcgagagaaaaaaaaaatctgagtgatatacggcaatcagccattcagttattctgattgcctaaatatgagatgttctaacagacactgcatgcgaaatctcttttgctgggattacaggcgtgagcaaccgcgccagggacttttttt

SEQ ID NO: 50556 - DNA, 367 bp, Homo sapiens
acctaacacctctgtgggtttatgaggatcagcaaaatagctggtctcttatctagttttttcctaagaaggttgtagagagaaatgcagggtagaaaaataagctatgtctgggtgtggtggcaacctcccaaattcccaaagttggtaaccttgggaagccaaggtaggtggattgcttgagcccaggagttcaagaccagcctggccaatatggtgaaaccttgtctctactaaaaatacaaaaatcagcctggtgtggtggcacatacctgtaatcccagctttttgggaggcttaggcacaagaattgcttcaatctaggaggcagaggttatagtaagctgagatcacactattgcactcc

SEQ ID NO: 50557 - DNA, 307 bp, Homo sapiens
tcgcagtcagaccgagaggatcctccctcacggctcacctcgaatcacactactccccatatctccacaaaaaaataaacaaaattagccaggtgtggtggcgtgcgcctgtggtcccggctactcaggaggctgaggtgggaagagcacttgagctctggaggtcgaggcttcagtgagccatgatctcgcccctgtactctagcctgggcaacagagtaagaccctgtctcaaacaaaaatgggtgaatagagaatgttctaagtcattactttccttgtgttgaggtatccgtatggtgaggca

SEQ ID NO: 50558 - DNA, 503 bp, Homo sapiens
agagaatggctttggtcacaactcagggatcgccacttaggcagacctgcaccctgcctcttgaccttgggaatcgcagtagaacagacagctaaccaatgaaacacatctagaaaacttctagaaaatagtttattaaaacattccaaggctgggcgtggtggctcatgcctatcatcccagcactttgggaggctgaggcggaagggtcacttgagcccaggagtttgagaccagcctagacaacatggcaacccctctccacaaaaaataaacaaaattagccaggtgtggtggcgtgcgcctgtggtcccggctactcaggaggctgaggtgggaagagcacttgagctctggaggtcgaggcttcagtgagccatgatctcgcccctgtactctagcctgggcaacagagtaagaccctgtctcaaacaaaaatgggtgaatagagaatgttctaagtcattactttccttgtgttgaggtatccgtatggtgaggca

SEQ ID NO: 50559 - DNA, 830 bp, Homo sapiens
aacagatactgtgtacctcctgatatgatgcactcagaagaccacagcatctcttctgggagaagataaatttctgcccaaaagatgttaagaattctgaagaactatagttcttcccagctgcattcgcacacaacagactctgaaatcctttttaccttacagagcctgccttggtcatcttcccaggaggaattcatgacaactgggatgcagaagagagcaaatgatctgctgggatggaaactgctcaatggagagtttgtggactgcatgatattccttgaacatcagggatggtacagggataccaatagtctggcctccaagacaggagagtaataggaggaagagcaaatctgtcttcacctgcagtattaatgggtggtgggccagaatggaggaaagcaagtgagtcatgtgctgctacaggttacaccaaactcccatccctctgttactcactgctgttgtcaaagccaaactttatcttgctaatttctcacagcttggcacctaacaaatgacaaggcaggacatccaatgccttcgagctctgtggtctggcctgtctctccagatcagatttagagtgaggtagcagatgacataatattctctttggtgttcaatccgaagaggccaatgcttcagcacaatgtcccctagccatcacccccagcccgactccccaccaagcatcctgcatccctctgccacatcttcattcttttccattctgtcttttccccgataccttctgaccccagggatttctaatagagcataatgatcaagaaaataaagacctggtacataaaaagtctcag

SEQ ID NO: 50560 - DNA, 320 bp, Homo sapiens
gaaatagggacggtgctattgaggatccagacacagttcaaaaagcttaccttcaagtcgggtagcctactcttttgtggactgtgtgtcacactgtaggaggcaggagaatggggatatcctcctaggaagatgtatcagaatctcagcaaagcagacctttcaagctgtctgtgtgttcccactgcacattctgatagacccccctccagggaggttgtcttctcatgtttaccattgcattttgagaatcactgctgctactgaaagatgggagaatgtgacccctgatgcgacccctgtgaatagttaggcgaagg

SEQ ID NO: 50561 - DNA, 192 bp, Homo sapiens
gaggctacaaacatgaggaaacaagtttacaagctaaagctggtggaaaggaaagctagggaaaaagtaggagtctgacagcattactacacagttgaactactgccagcaaccactcacctctagacctcttgctaggtaagaaaaataactccaggttacttaacctctgccaggtttctttcacctgta

SEQ ID NO: 50562 - DNA, 346 bp, Homo sapiens
aagctatttgcgtaattcacagtgcttatgactgaagcatagacttaggagaaagagttgcttcatggttctttagatttgataaagttaggaaaaagttccttccaaaccataaggaagttgtgcaataatatatttagagtttggtaaatttgtttgggggaagggagcattattttgttgagaaagacatgagatgtcctgattcaatatctaagttctagctccagtcctgggagcggtagaggtgcctgcacaccaagctgctccagttattaaggcttctccttgactttttgagaaaagacatattgcaggaattaaacttatccttgctagaagaaca

SEQ ID NO: 50563 - DNA, 555 bp, Homo sapiens
tcccgcagaggcctgggaggctgagggtgaggaaggccagctgtgctggctgcaagagggctttgctgtttctccacagagcagcaggtcgccccttcccttctccctccctccacctcacctccatgggctccactggatgggaaccatgtgcttgttctccccacccctagactgggatctcctggggcagaagaggcttcccaagtggcacagacagagccaggctgactgaatgtgagattcatgaatgaacagtgataccaggcatagccctgccctttagcatcctgagggccacgtggagttttctgcaacactgcccgccgtgttccagcatctgccttccacttgctagggagaggtagaggtgaagtggcccttctttctgtcttggcattcctgtccaccctgcctctagatctccactttccatggccgtaggagaacaggacctctaccctcctcgagtgccgctatagccagcgtgtgctgagcagggcccaggcagccctgagaaggcgccagcatgctctgcctcctctgcactagcag

SEQ ID NO: 50564 - DNA, 344 bp, Homo sapiens
aagtgtttcaggtgggtcaagaacagccctgagccaggcggagttggagagaagctgtagtttttaccaaattgtgtacatctgggcagatgtttaatttctgtgactaatcactgaactagatgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 50565 - DNA, 4376 bp, Homo sapiens
ctggaggcggctcacgcgggttcccaggagctgattgatggattttcaggaattctggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagatgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 50566 - DNA, 4344 bp, Homo sapiens
gtggggagggcggatccaggtctggagtctttggattgaaaggttggagatgcctgtgggactcccaagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagatgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 50567 - DNA, 4328 bp, Homo sapiens
ccccaactcctcgcaaccatcctcctgggctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagatgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaaaaaaaaaaaacaaaacatcacaacaaaaacaaggcgggggggcgcaaaaaaatcccccgggggcccagataggccccccgttttttggtcaaggggccccaagggggcgaataagagcagggccgggcgggtaacacgcggggggaaaaggcgctgggccggagggccctctggggggcgggccacccag

SEQ ID NO: 50568 - DNA, 1781 bp, Homo sapiens
ccccaactcctcgcaaccatcctcctgggctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaaggtaaatcatcatcataggagtgtggaagctgctggtacaaaatgagtcaggggaggccgtgaagaagctctcgaagacctgcctgtagcagaactcaccccagaaccctcgggactgcgacgagggcgcccgcccagtgacggccactcctgcggtgaacagtactgcctcctgccaggagctgctgtgacctgtgaacttcgttctagagcagcttacatggacttctttgccttttaaagtgttgcctttgtcgcgaacaccccccaaaatgccttccagtgtagcacgcatatcctgactgcaatccccttgctgttcctgaataaactctttcttaggagaacactct

SEQ ID NO: 50569 - DNA, 4389 bp, Homo sapiens
gtggggagggcggatccaggtctggagtctttggattgaaaggttggagatgcctgtgggactcccaagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagatgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 50570 - DNA, 4137 bp, Homo sapiens
ccccaactcctcgcaaccatcctcctgggctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagatgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 50571 - DNA, 3904 bp, Homo sapiens
ccccaactcctcgcaaccatcctcctgggctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggaggctcctttgctcctcatttgtcctgaaaatcttaatttgggattgatccaaaaatttgccccccccttcccttcgaaccatctgtttaattttgaatgccccctacaaaatttccgtgaatggctcgtgaacctttcctgttggattcaaagaccct

SEQ ID NO: 50572 - DNA, 1068 bp, Homo sapiens
ccccaactcctcgcaaccatcctcctgggctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggttcggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtggtgctgacaagggacctcagcttagaggggcagaggctgcctgctccaagcaaggatggccccagctgggacttgggctctcttgagctgagctgtccctcctgggtcggccaccacgt

SEQ ID NO: 50573 - DNA, 1069 bp, Homo sapiens
tgaaattgttaatgattttattcttgaaccaggggttctcttcataggtacttgctatatgtttttaaatatttactggatgaatgtaacggatgaatgagtaaataaatcagagagggcctcacatggaccaaagtgagtgacgctgggaacccagggttgtggtccattctgctcgtcctgcagaactccaggaggcagcattctatgggcttatgagctccagcagtgtttggaggacagggttggccagagactacaggagccacagactaagggcacagccaaggaaggaccccaagaccccgtcctgtgttggtgtgagctgggaaagccgcccagggaaagggctgtgcagccacccagtgctgctgaaatcagaaatctgccctcaaaacccctggaaccaggaagcccagctctgccctcctcctggggccctcgggtccacgtcagctggaagggagacacctgggatcacagaggggcagctggggtggggctggagccaagaggcagtgatgggcagctgaccactccctcagacaggagctggccatgcccctgccatcctctctgctcaactctctaccacatgtcacagctggcatcgcaagctagggggaaatagctggaccatgcacgattgtaaagaagacattcagtgttactatctgttaaatgatatgatgaccagaaaaccccgaaaattcacaggtaaatcatcatcataggagtgtggaagctgctggtacaaaatgagtcaggggaggccgtgaagaagctctcgaagacctgcctgtagcagaactcaccccagaaccctcgggactgcgacgagggcgcccgcccagtgacggccactcctgcggtgaacagtactgcctcctgccaggagctgctgtgacctgtgaacttcgttctagagcagcttacatggacttctttgccttttaaagtgttgcctttgtcgcgaacaccccccaaaatgccttccagtgtagcacgcatatcctgactgcaatccccttgctgttcctgaataaactctttcttaggagaacactct

SEQ ID NO: 50574 - DNA, 953 bp, Homo sapiens
gaaaaagcattattacataatgcaaatattttttaatatagttatctctctcctttttagaaatagaaattttctgccgttaaatttttttttgagatagagtctcactctgtctccaggctggaatgcagtggcacgatcttggctcactgcaacctctgcctcccgggttcaagtgattctcctgcctcagcctcccaagtagctgggactacaggcgcacaccgccacacccagctaatttttttgtattttagtagaaaaggggtttcaccatgttggccaggatggtctcaatctcttgacctcttgatcccctctcccggcctcccaaagtgccggaattacaggcatgagccaccacgctcagccgctattaaatattttaaaatgtgtagaacttctagtcagcatttttaaatctgtagaccttaatatgtgaaatagccaagtcccctcatgtttgactgtcaaataaaattctgctgctcaaattgtattcctccataattccctgctatagacctttaggctgttttaatgtccctacttgtaccacagagtattaggacttccttggcctgcctgcattcattttagagtctgaattctggggactcaaaagtttctacaagacagctgagcagtgctttgactttaatgtgacttacacatcataaatgactttcaaatgaaatttgaatttcaaaattctgtaaaagtggttgctcaaaagatgtatgatactattttaatcagtttaagagcaaaaatgtctaattgtatttaacaatggtatttgggcagccagaaaatattttaagcgttgctctaaaataatttgaagtagctcatctgttattacatcagatgcttcttgagtgcccaatttatacatggcctgtggtaaataccatgtgagctttgtaggaatacctttaaatattcctcac

SEQ ID NO: 50575 - DNA, 521 bp, Homo sapiens
gtaatatggaatgccaatctaaaaactacatgttttgggtggtctttatggaattttttagctataaccatcagaaaacaggcatacctagatgacagatgaaccttcttgatttttgaaacccattgaacaaaaatattttgccaattattgtgtttatgttatttaaaattttatgtaaaccttaattttgtagcagtaaattttgtttaagattttgctatcagctccctatcacctgagcaactttttttttgttgtatatgtttttttctattctatttcggaatagagaatttacttaaaatttttattttctccaaaaatgtggaaaatatgtcacctggtttcctggtttatggtagcatattctgtttaaattagtgtcacatatttagatgtgtggccagacgcttgatttattagttaatttttgagacagagtctaactgtgtcactcaggctggagttcagtgagctgaggtctccagcgtgggcgacagagtgagactctatctcaa

SEQ ID NO: 50576 - DNA, 2104 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcca

SEQ ID NO: 50577 - DNA, 460 bp, Homo sapiens
catttccaagaattcctgcagtgaatcctttcacaaagccaagcgttcttttatgatgtgaatacctgtgcagtttatctgctttgtaaacctgggtgtgcgttcagtgggcttttaatggtgaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50578 - DNA, 857 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccgggtaaggggctcgcactgccgtccgggtagctgctgtcagggctccctgactggcttgggactgagagacagaggttggggggcaggaggagggttggatgggggcacgaggggcagtgggagagtgagtggggctgagagaggcaggaggaacgggacaggaggagcggcggatggggcacgcacagagtgcaagacgctgagcaatgcagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgggaggctgtgtcttactcatgcagggtggtggaggggcgcctcttagcagaagatgatgaaaggctgtcccctctcaggaaggagaaggtcctcgtctgttccaaggcaaagaactggacaagaaggaggaggttcattcagtacattgagtctgatcctccctgctgtagctggagcacggtccctgaagctggctgaagtgctaaagcaggggctagcaaactgtggccgaatcccacctgctgcctgtttgtataaataaagttttattgggacacaaccatgcccaccattcac

SEQ ID NO: 50579 - DNA, 934 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgagatggggttccgccatgttgcccaggctggtctctaactcatgagctcagtccatccgcctacctcagcctctcaaagtgcggggattacatgcatgagtcattgcatctgatcaggaggccttatcttctgagtggactggggtggtggcccatgaacaggatggggatcacgcaatcccctgcaaccctcttcggcttcgtgacacaaatgcaagttacctcaagaggttctccctgaccttggtgatgccgtgggcactcacagaagcctcctctgtgctgcagggaggctgtgtcttactcatgcagggtggtggaggggcgcctcttagcagaagatgatgaaaggctgtcccctctcaggaaggagaaggtcctcgtctgttccaaggcaaagaactggacaagaaggaggaggttcattcagtacattgagtctgatcctccctgctgtagctggagcacggtccctgaagctggctgaagtgctaaagcaggggctagcaaactgtggccgaatcccacctgctgcctgtttgtataaataaagttttattgggacacaaccatgcccaccattcac

SEQ ID NO: 50580 - DNA, 1806 bp, Homo sapiens
  misc_feature (1806)..(1806): n is a, c, g, or t
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtgaccacccccccccccccccccccccccacccccacgaaaccctgagcgggn

SEQ ID NO: 50581 - DNA, 2132 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccgggaatgtggactttttttcaaactctagaatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcca

SEQ ID NO: 50582 - DNA, 2315 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccgggtaaggggctcgcactgccgtccgggtagctgctgtcagggctccctgactggcttgggactgagagacagaggttggggggcaggaggagggttggatgggggcacgaggggcagtgggagagtgagtggggctgagagaggcaggaggaacgggacaggaggagcggcggatggggcacgcacagagtgcaagacgctgagcaatgcagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcca

SEQ ID NO: 50583 - DNA, 1153 bp, Homo sapiens
tgaaattgctatcgaaagtccggactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50584 - DNA, 1167 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50585 - DNA, 1533 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccaaaaaaaaaaaacaaaaaaaaaaaaaaaaaaaaaaaaaaaaaaaaaaaaaaaaaaaaaaacaaaacacacgaaccacacacaacacgggacacatccatcgagggcggaaacaaccacaaacaagggcgccacgcacacacggtcccacaccccccctttgtaaaacgggagaaaatcggggggccccccaccaagaggggccgcccaacatctacagcagacacccgggtcctccgtatagggcgcgacgaacgagacagcagcacgccatgcgcgcacgcgcgcgcctgcgccgcgcgaggtctagtaacgcgcggggagcacactaccgcgaagcacacaaacagtccacggaggactaacggacgcacagcctcaccgccgcagaaacacgacaacagaccaacgtaagcaacgaaagcatgcgcacggcc

SEQ ID NO: 50586 - DNA, 844 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcgccgcaagaccgtcccactcaacaggctgcgaacagggatccttagatct

SEQ ID NO: 50587 - DNA, 646 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgggaggctgtgtcttactcatgcagggtggtggaggggcgcctcttagcagaagatgatgaaaggctgtcccctctcaggaaggagaaggtcctcgtctgttccaaggcaaagaactggacaagaaggaggaggttcattcagtacattgagtctgatcctccctgctgtagctggagcacggtccctgaagctggctgaagtgctaaagcaggggctagcaaactgtggccgaatcccacctgctgcctgtttgtataaataaagttttattgggacacaaccatgcccaccattcac

SEQ ID NO: 50588 - DNA, 1979 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50589 - DNA, 2538 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccaaaaaaaaaaaacaaaaaaaaaaaaaaaaaaaaaaaaaaaaaaaaaaaaaaaaaaaaaaacaaaacacacgaaccacacacaacacgggacacatccatcgagggcggaaacaaccacaaacaagggcgccacgcacacacggtcccacaccccccctttgtaaaacgggagaaaatcggggggccccccaccaagaggggccgcccaacatctacagcagacacccgggtcctccgtatagggcgcgacgaacgagacagcagcacgccatgcgcgcacgcgcgcgcctgcgccgcgcgaggtctagtaacgcgcggggagcacactaccgcgaagcacacaaacagtccacggaggactaacggacgcacagcctcaccgccgcagaaacacgacaacagaccaacgtaagcaacgaaagcatgcgcacggcc

SEQ ID NO: 50590 - DNA, 2042 bp, Homo sapiens
tacaacgaacaaacgaacaggagagacaccaaagatgtactacgggcgagacgcgggtggtaatttcaatcacggggctggtagtataatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcca

SEQ ID NO: 50591 - DNA, 1074 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagaaggagagcagaagtcgacaagtcctgtaga

SEQ ID NO: 50592 - DNA, 1053 bp, Homo sapiens
gtgcactggctttcagcataggactaggagaaaatccaaatgagcacaagacccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50593 - DNA, 974 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50594 - DNA, 1185 bp, Homo sapiens
acgtcatttccggcgtttgggcggggcccgggcagggcgcgctgcccggagctgcctgggttgcgctgccggccacgtccccgcgccgggcctcaggctccttcctactgtccgagggccaccaggccgccgggggcctgctgcgcccgggtaaggggctcgcactgccgtccgggtagctgctgtcagggctccctgactggcttgggactgagagacagaggttggggggcaggaggagggttggatgggggcacgaggggcagtgggagagtgagtggggctgagagaggcaggaggaacgggacaggaggagcggcggatggggcacgcacagagtgcaagacgctgagcaatgcagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcata

SEQ ID NO: 50595 - DNA, 2369 bp, Homo sapiens
gtcagtgcccgcgcagcgttgagttgcacagcggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggctgctgcactgaataatgattccagccagaatgtcttgagcctgtttaatggatatgtttacagtggcgtggaaactttggggaaggagctctttatgtactttggaccaaaagctttacggattcatttcggaatgaaaggcttcatcatgattaatccacttgagtataaatataaaaatggagcttctcctgttttggaagtgcagctcaccaaagatttgatttgtttctttgactcatcagtagaactcagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtttgtcaattaacagatgaacagatccatcacctcatgaaaatgatacgtgatttcagcattctcttttacaggtgccgtaaagcaggacttgctctctctaaacactataaggtttacaagcgtcctaattgtggtcagtgccactgcagaataactgtgtgccgctttggggacaataacagaatgacatatttctgtcctcactgtcaaaaagaaaatcctcaacatgttgacatatgcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattgattcagtgctcaagagtgaagaaaattctactgtctttagccacttaatgaagtacccgtgtaatacttttggaaaacctcatacagaagtcaagatcaacaggaaaactgcatttggaactacaactcttgtcttgactgattttagcaataaatccagtactttggaaagaaaaacaaagcaaaaccagatactagatgaggagtttcaaaactctcctcctgctagtgtgtgtttgaatgatatacagcacccctccaagaagacaacaaacgatataactcaactatccagcaaagtaaacatatcacctacaatcagttcagaatctaaattatttagtccagcacataaaaaaccgaaaacagcccactactcatcaccagagcttaaaagctgcaaccctggatattctaacagtgaacttcaaattaatatgacagatggccctcgtaccttaaatcctgacagccctcgctgcagtaaacacaaccgcctctgcattctccgagttgtgaggaaggatggggaaaacaagggcaggcagttttatgcctgtcctctacctagagaagcacaatgtggattttttgaatgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatga

SEQ ID NO: 50596 - DNA, 1431 bp, Homo sapiens
gtcagtgcccgcgcagcgttgagttgcacagcggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggctgctgcactgaataatgattccagccagaatgtcttgagcctgtttaatggatatgtttacagtggcgtggaaactttggggaaggagctctttatgtactttggaccaaaagctttacggattcatttcggaatgaaaggcttcatcatgattaatccacttgagtataaatataaaaatggagcttctcctgttttggaagtgcagctcaccaaagatttgatttgtttctttgactcatcagtagaactcagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtttgtcaattaacagatgaacagatccatcacctcatgaaaatgatacgtgatttcagcattctcttttacaggtgccgtaaagcaggacttgctctctctaaacactataaggtttacaagcgtcctaattgtggtcagtgccactgcagaataactgtgtgccgctttggggacaataacagaatgacatatttctgtcctcactgtcaaaaagaaaatcctcaacatgttgacatatgcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattggtaagactgaattttgattttgagtttgttacatttctaagagggttaattatacaaagtcaggaatatatcttgctccatcttgatattccataactaaataaaatttctttctcaaaggtttaaaggaattgccagttttcacatgtaaaccatgctaatattctgttgagtattttttttgaacagggagggaaagcatgtttgtgctataacagtatgtgcctttgtatctcaaaaaaatggagatgatcacatctgttctctactgtttctaatgaattattcaataaagctttgttttatgca

SEQ ID NO: 50597 - DNA, 599 bp, Homo sapiens
caagcaataataaagagatagcattggggtattaatggttctataatcatttctaaaatatccagacaagaacaaggcaataataacaatgattaattttaaaaattatcttatagcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattggtaagactgaattttgattttgagtttgttacatttctaagagggttaattatacaaagtcaggaatatatcttgctccatcttgatattccataactaaataaaatttctttctcaaaggtttaaaggaattgccagttttcacatgtaaaccatgctaatattctgttgagtattttttttgaacagggagggaaagcatgtttgtgctataacagtatgtgcctttgtatctcaaaaaaatggagatgatcacatctgttctctactgtttctaatgaattattcaataaagctttgttttatgcagatt

SEQ ID NO: 50598 - DNA, 1400 bp, Homo sapiens
gtcagtgcccgcgcagcgttgagttgcacagcggtattctcaccaggccctgcaatcggaagtcggaagagcactggacctgtgtggtgtgtactttaatcaataagccctcttctaaggcatgtgatgcttgcttgacctcaaggcctattgattcagtgctcaagagtgaagaaaattctactgtctttagccacttaatgaagtacccgtgtaatacttttggaaaacctcatacagaagtcaagatcaacaggaaaactgcatttggaactacaactcttgtcttgactgattttagcaataaatccagtactttggaaagaaaaacaaagcaaaaccagatactagatgaggagtttcaaaactctcctcctgctagtgtgtgtttgaatgatatacagcacccctccaagaagacaacaaacgatataactcaactatccagcaaagtaaacatatcacctacaatcagttcagaatctaaattatttagtccagcacataaaaaaccgaaaacagcccactactcatcaccagagcttaaaagctgcaaccctggatattctaacagtgaacttcaaattaatatgacagatggccctcgtaccttaaatcctgacagccctcgctgcagtaaacacaaccgcctctgcattctccgagttgtgaggaaggatggggaaaacaagggcaggcagttttatgcctgtcctctacctagagaagcacaatgtggattttttgaatgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatga

SEQ ID NO: 50599 - DNA, 1793 bp, Homo sapiens
gctcacacctgtaatcccaccactttgggaggccgaggcgggcggatcacctgaagtcgggagttccagaccagcctgaccaaggagaaatcctgtctctactaaaaatacaaaattagctgggcgtggtggcgcgtgactgtaatcccagctactcgggaggctgaggcaggagaatcgcttgaaccccggaggcggaggttgcagtgagctgaatttcaccattgcactccagcctgggcgacagagtgagaatccgtctcaaaaaaaaaaaacgtttttttcacaaggaattctgaggacttgttggctcaattgcttggacataaagacacacatacatgaagctggagagataggaagaagcgctcaacacagaacaccctaagtatccctactccctttcaaggactaaatcccttcagagatttcctttgcttcagtccttcaggagcctcccgaagatgctaggagtcgtttaagaaggctggaagatggccgttgggaaggaactgttggtagctggcaatacttcatcccaaggaggcggtggcaatagctccctgggcagcagacatcatggattttcctccctctgggaaccagaggtccctccgtttctggtttgaatcccttagagacaaagaacttcattctctcccatacccgcgtgggactgctggggaggagagggggtggaggggttagacttctacgaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaacttggg

SEQ ID NO: 50600 - DNA, 990 bp, Homo sapiens
gctcacacctgtaatcccaccactttgggaggccgaggcgggcggatcacctgaagtcgggagttccagaccagcctgaccaaggagaaatcctgtctctactaaaaatacaaaattagctgggcgtggtggcgcgtgactgtaatcccagctactcgggaggctgaggcaggagaatcgcttgaaccccggaggcggaggttgcagtgagctgaatttcaccattgcactccagcctgggcgacagagtgagaatccgtctcaaaaaaaaaaaacgtttttttcacaaggaattctgaggacttgttggctcaattgcttggacataaagacacacatacatgaagctggagagataggaagaagcgctcaacacagaacaccctaagtatccctactccctttcaaggactaaatcccttcagagatttcctttgcttcagtccttcaggagcctcccgaagatgctaggagtcgtttaagaaggctggaagatggccgttgggaaggaactgttggtagctggcaatacttcatcccaaggaggcggtggcaatagctccctgggcagcagacatcatggattttcctccctctgggaaccagaggtccctccgtttctggtttgaatcccttagagacaaagaacttcattctctcccatacccgcgtgggactgctggggaggagagggggtggaggggttagacttctacccccatgaaacacccgcgggctcaaagaggagcctggatcctgactggtccaggaggcgtgcggggccgcggggcccctccggcttgggccaggcgcgttgccaagatgcccggggaaggggccgcccggcgcaggccggggacgtggagcgctcggggcgctcccacgtaggccacacattggccgcctgtatcctccttctttcctctcaactccattctctcgcgcttttttcccggggagcctccgctttccccttcttcccgcggccgc

SEQ ID NO: 50601 - DNA, 416 bp, Homo sapiens
tgtaccggctgttgcggacaagccttctcatgctgggcggattggacgggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctgtgcacgggggctcctcgagagtcgacgctgc

SEQ ID NO: 50602 - DNA, 2064 bp, Homo sapiens
catgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaacttggg

SEQ ID NO: 50603 - DNA, 1540 bp, Homo sapiens
catgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaacttggg

SEQ ID NO: 50604 - DNA, 1307 bp, Homo sapiens
aaaacaaaacaaaacaaaacaaaaaatttactatgggcctattttatatactgctaagcctgggctgttcctgctcatgactgctaaatgagcaccagacatttaggtacctgaatacttgtcattttggggcaaaagaaccagcttattcttttgctccagaatgtgttcaaattagattttattcaagtgtcaataaattttataatgttttcttccctatctaataggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaacttggg

SEQ ID NO: 50605 - DNA, 879 bp, Homo sapiens
ccctgctgatacgattcgagctcgtacccctccagctggccccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaacttggg

SEQ ID NO: 50606 - DNA, 1168 bp, Homo sapiens
  misc_feature (1168)..(1168): n is a, c, g, or t
catgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaagtaagggaaatcccatttggaggcaagatggaagacttccgtttaaagcttggttccggattttaaaaagtaaaaacaaacttccaagactcttctattaaaaaggaaccttggggtcttatttgaatcggtggacggaatgggggccacgagccccttcccggcttttggtggcccccccn

SEQ ID NO: 50607 - DNA, 2045 bp, Homo sapiens
catgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagatcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaaaaaaaaaacttggg

SEQ ID NO: 50608 - DNA, 2059 bp, Homo sapiens
catgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttgtttgaaaaatagtttgtagaccatttgatttaaatatatgaacaaccaatgggctactgcaatccaagtaaacgtcgacg

SEQ ID NO: 50609 - DNA, 1611 bp, Homo sapiens
catgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctctgcgtttgcaaacgcagagaggaagaaaagcaactaccacaacaaaatcccccagaaaaccctgaaaaggcaaaaccaggaggggaacgttaagagggaaaacactgtatcattggttcaccataactggcctagcaaacattagccacagtgaaagggaggggcttcctccttgggagttcttccactggcccagctccccacgggggctggagcagggctggaaaaaacaggagctcccctcctctctgcgtttggggaagct

SEQ ID NO: 50610 - DNA, 7205 bp, Homo sapiens
  misc_feature (4687)..(4687): n is a, c, g, or t
  misc_feature (5650)..(5650): n is a, c, g, or t
  misc_feature (7074)..(7074): n is a, c, g, or t
gagcgctccaagatggcgcccaccgcagtcccgcccgccgcatcctcggcgcctttgcagtccggccgcgcctcccgggccccgcgttagggccgccgctgcctccctcgccgccgccgctgccagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggatccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaaccnattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagccnaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctcnaacatacagccattgttgcacattttgcaagatgaactatttaatgctgctctgtgtccagtacatgggggagactttgatcccaaatggcttgtactatttatgtcactgtaaaaccaaatcctagggct

SEQ ID NO: 50611 - DNA, 6777 bp, Homo sapiens
  misc_feature (4687)..(4687): n is a, c, g, or t
  misc_feature (5650)..(5650): n is a, c, g, or t
gagcgctccaagatggcgcccaccgcagtcccgcccgccgcatcctcggcgcctttgcagtccggccgcgcctcccgggccccgcgttagggccgccgctgcctccctcgccgccgccgctgccagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggatccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaaccnattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagccnaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtccgagtccgctgcattggatcctctagacgcga

SEQ ID NO: 50612 - DNA, 496 bp, Homo sapiens
ttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggttggtgatgaattctttgcaatagaccttcctgccagatcatggtgactaagaccccatctgattttcactgcagttgatcttttctaggcatattttcaaatagaggccattggtctgatgaaaataacccaagtaacaactgcagatggttgctccaattattccatttgtcttaacagccaaattgtttgttcatatcatcttttgttgaattgctcaactgttcagtgtgcaaccgccatgatgactgggaagaaaaaagtgaccagggcagtttatatagtgtttcacataagcatattctttttcttgggagaaatgttaagattcctgtggtcataaaaagtat

SEQ ID NO: 50613 - DNA, 6185 bp, Homo sapiens
  misc_feature (4095)..(4095): n is a, c, g, or t
  misc_feature (5058)..(5058): n is a, c, g, or t
ccgttggattcatataatctacctgacaaaactcagcactcaggtaaattgttatttgcaaggcctgccttttcacagtctgttcaaagacattcatcctagggggagtcacacttgtaagtaaaactgatgtgttcagtagctgtgactccaatgagagacgcattaaactctctgtaatgtccattaaaattccataatacttatatcaatattctttgctgcacaaagcaaagacagagcctagatgacctccatgaaaaagacatgcttaaagttccgttgaagccgtcgacggcttcaacggaactttgggatagcacttttaatttgtaaatatatataagaaaatcattaataggaaagaattcttatcagctgtcacagctgttggaaaagatttatgagctaaagtcaataactttctgctggggctagttaggaacagtgtaaccttattctctcattcacttaaatctgcctgttcatttcctgcctcttcaaacttttctagcaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaaccnattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagccnaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtccgagtccgctgcattggatcctctagacgcga

SEQ ID NO: 50614 - DNA, 775 bp, Homo sapiens
gagctcctgtgtatggtatgtgaggccagaaggcagatttcatgattgctgttttactgatggaaatacacaagagatcgaagtgacttgctcagggtcatagagggaggcagtgccatgccgaggctgaggtctttcgatttctagctcagtccagtcccaccactgcagtatctccaagccacagcattgggatttggttgtctcacagtgaaagtaaacctgtctgcactcagatccttttctccctgttgtcgggaggtgctgggacagtgggaattgtgagactggaggtccagaggctggctgtctgctaagccatccaccaggaggctgagaagtaagcctgttgtgcctgccctgccacattccagggctgttctgttctccccgagggaatgggggcctgctttatttttagctagttcagtgtgacagccttgttctctttctgggcaaggacttggccacttttaccagtcaggaagctccctttagaacctccaggccctactcaggttctcctaggaagagggggccaagggaaggggagctgaagttggagtgccgctctgcttgctgggggcctggggcatttggcttaactgcacagccctaggttccacctgcctcatgtggggttcataacagctaccttacacattgtgcagatttggatggaggagcttagagcagccagcgtgggccctgtccacattcacgttgctgggattataggcacgagccaccgcgcctggcctattattgcatcttt

SEQ ID NO: 50615 - DNA, 332 bp, Homo sapiens
ctccagagaacatacataaatgatcactcagcacaacaaaaggttgcttggcatgactgggcatcagagaaacacaaatcaaaacacaaaaccacttcacatccactaggatggctaaaataaaaaaagacaataataaatgttgccttgtacattgctggtggaatgtaaaatggtgcagtcactttggaaaacattctgacaattcctccaaaggttaaacatagttatcacgtgacccagcaattccattcctgtgtatgcacccaagaaaatggaaactgtgtatccatacaaaaacttgagcataacttcttagcaggctgctaagc

SEQ ID NO: 50616 - DNA, 344 bp, Homo sapiens
tcgaggctgcagtgagccaagatggtgctactgcagtccagcctgggtgacaaaataagaccctgtctcaaaaacaaacaaaaaaagcggaaacaaccatactaagtttacagtattgtttgtgtgcctacttggtggaagaaataaattcttagaagttacactttctttaaaaaattaaaaattaaaaactgtgcagtgttgagattagtattaccgcttatcttgctgacttgtgaaattgaattacatcacttataataatgtgaagttttagaaattgttttgatgataaagagtagcagcctttaagagaaataatataaaccatgtttcctcaaatc

SEQ ID NO: 50617 - DNA, 461 bp, Homo sapiens
attagtatccaacaagacaagaatattggctattgtgaagaatgctgctgtgaacaggggagtactactataatcttgtcttattatgattcacaatagtcaagatatggaaacaccctaactgtccattgacagataaatggataaagaaattgttgtttctctctctctctctgtgtgtgtgtgtgtgtgtgtgtgtgtgtgtgtggaaaatatatatatatagggtgatggtatatacatatatatatatatatatatggtgatggtatcaaaaagataaaatgactgctctacaattattctcattttgaatttcattttaatttacagttttcaaaactaaatgccacctgtcttttgacactgttttcattattgaaggttttatagctttaattttatattaataaaattaattatgtaaacatttgcttgcttttaggagcaaagcataggct

SEQ ID NO: 50618 - DNA, 1493 bp, Homo sapiens
acccagagagactcaggggaaattagagcatgatggcggccgaggtcgcttggcgcaaccatcgtcttttttctttatttttagctcattagtgccttgcctcggcgctgtttccctaagctcctctctccaaccagtactgccctataacggaatccatacgtgccggctccttgatttatcccctccgaagtgctgagtgtgggctggttgtgcgtcattggactgtcaggatgtcactccccagtcaaatcttcaagctattggtggaacagcaagaaagcccgtccatcaacaagggctaataccattggtttgactccactgtgttatttcctggcaccttattgggcaaataggtgcgtcagatccggattcgctctgctacggttaattgtttactggggatttggggtcaactctggttgtttggccagtagttgacgataatagtgactcccttgcctattttgtgccaagtattgggctgctttcttcacaaacattatctggttaaacctgggagtaatgcagtatccagtttttatagatgggaaattaaggctggcgagagcttagaaaacttgcccaaggtcatccagatacagagtcgttggtgggcctggcatctggtcctgggtcaaactgcagagacttcactctttttattatgctttagtgcctccaccttagacgatgtacttgtcagccaacctagcatcttaaaaacgtttcatttggaactcaaagtcttcagtcagtttctagaagtgactttgttggggacttactatggaaaggttgtcattgcctccaccacatcttcctccccaggacccattcctctcccctttaaggtagacatttctgcctccttttatgcgaagcctaggcaccactcgcaacccctgaccaaccatctacaactcattctttggagagagtcctcaagagctggaaaactaggagaaatcaagtctaaagagagagacagaataaatcgtcttagaaatgaataatttattgcatgcaaagagaacagcccttcagctcctggaaatcttccaggatagttgatgctgagcaagacgtgtgctcctggctggtggccactgggttctttccctatagcagcattcatcgaagtgaatccaacatttcagccagaggagggcaggacgcttaggacccattgccagtgagcttttgcgaccgaaatgatctccaggagcacaacgctggactctagcccacattccatcttgggtaattaacattttaccgtcccaaatccccatcccctgtagcttcagtgggatcaccgcccttgtttcacttcctgatccaagctgttgtgtaacctccttggcactgctttaataataaaacaaccattgtaacatagtaacaatgctcaacacttagagcctttcagcaaatgaagccaaggtatttcataaacgtcaattaagagtaagtggcatgtattccta

SEQ ID NO: 50619 - DNA, 283 bp, Homo sapiens
ggtgtgaaatgcagtcggcttctcctgggaaggtgactcagacagaagctttcttcacaagcatgctccccacggcctcctccctttcacctgcaccatgtctgtctcccattcaagactggcaaccccagccaggcacagtggctcatgcctgtgatcctatcattttgggaggccaaggcaggaggatcccttgaggccaggagtttgagaacaggagacaacacaacgaggctctatctgtacaaaatataacaaaacttagccaggcaaggccatgtgt

SEQ ID NO: 50620 - DNA, 4042 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgca

SEQ ID NO: 50621 - DNA, 343 bp, Homo sapiens
gcggccgcctactactactaaattcgcggccgcgtcgacgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgca

SEQ ID NO: 50622 - DNA, 2814 bp, Homo sapiens
gagagagagagagagagagagagagagagagaggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgca

SEQ ID NO: 50623 - DNA, 792 bp, Homo sapiens
gaggtgttctagaggatccctgcataggttcgcaggaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgca

SEQ ID NO: 50624 - DNA, 4195 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgcaaaaaaaaaaaaaaaaaaaaaaaaaaaaaaaaaaaaaaaaaagagggggggggggcgcccaaaaattcccccgggggggccccatttacggtcccccggtttgttgtgtgtcaccagagggggcccccctaaatggggaggcacagctgatataaagcagccgaggcacgcagcggcgcgtgttaacacaacacgtggtcgaggtcggggaacaagcgcgtcacgcgtgcgcacacctggtgggagagagaaccccatcactcgcgggcggggggacccatcggcggcgcgaacatcacctcgcgagaaattaaagacctcaagggacaaca

SEQ ID NO: 50625 - DNA, 3626 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgca

SEQ ID NO: 50626 - DNA, 2579 bp, Homo sapiens
  misc_feature (2153)..(2153): n is a, c, g, or t
  misc_feature (2156)..(2156): n is a, c, g, or t
  misc_feature (2166)..(2166): n is a, c, g, or t
  misc_feature (2168)..(2168): n is a, c, g, or t
  misc_feature (2176)..(2176): n is a, c, g, or t
  misc_feature (2178)..(2178): n is a, c, g, or t
  misc_feature (2190)..(2190): n is a, c, g, or t
  misc_feature (2400)..(2400): n is a, c, g, or t
  misc_feature (2456)..(2456): n is a, c, g, or t
  misc_feature (2579)..(2579): n is a, c, g, or t
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtggtacttnttnattttacttnantaataatnantttttataattnccaatttacctccttttattacaacattcacttttctaaatttaactctttacactcccaaaatcatattttataaaaaaaacttcattacccattattacctctttctttcccaaacctccttccatacatcaatattttaattttaataacttctcaacaagaaaaaaaaacattaaacttcactcatccaaaaaatacccctacaantcacaccccttttttttacaccttttattccaacattttttcaatcctaacaactnaatcccttaattaaaaaaaataataacattcttttacaccttttttaaaaaacttttttatattccccctttttccccctcttttccccaccccccctttttcttcctctcccccttccaccn

SEQ ID NO: 50627 - DNA, 154 bp, Homo sapiens
ttgatataagaggagaaacggtcttctctgccttttggttgcaggttgccatgtcaaatcttagcgaggctgtgcaggatgcagacctgctggtgtttgtcattccccaccagttcattcacagaatctgtgatgagatcactgggagagtgcc

SEQ ID NO: 50628 - DNA, 3864 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgca

SEQ ID NO: 50629 - DNA, 2732 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaggtgccactccaagggcggtcctcggtgcagcagcagcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacaactccggcacaactcttctcagtagtctcgagtcc

SEQ ID NO: 50630 - DNA, 216 bp, Homo sapiens
  misc_feature (3)..(8): n is a, c, g, or t
  misc_feature (11)..(11): n is a, c, g, or t
  misc_feature (95)..(95): n is a, c, g, or t
cannnnnncgncttcagctgtaaaggacctggccagaatgtggctgtgaccagggcacaccctgactcccaagggaggcggcggcggcctgagcngggggcccgaggaggccaggtgttttacaacagcgagtatggggagctgtcggagccaagcgaggaggaccactgctccccgtctgcccgcgtgactttcttcacagacaacagctactaa

SEQ ID NO: 50631 - DNA, 280 bp, Homo sapiens
attttcacattgagtaggctgaggaggaagaacagcaatgattagtcttgctgtctcaggcgtgctagagatggaagaaaatctgcatataagcagatccttgcagtttaaatctgcatttgcatataaaatacaaaagagaatgtaaacattttaagcaataaaataaaaacctttaaaatatatttggttgaaatttcagaaatagacaagagaatgattgaggtagagaaatatttaaaaatatattgactgaaaattttctcatctgatgataaag

SEQ ID NO: 50632 - DNA, 423 bp, Homo sapiens
tccaccctacctcttaggaactggggagcaactcttcccactgaagaaagagcatggctcctggctctttaccaaatctctcattttttagttctcagatgtgatttttctctctgacactccttaatccaacaccttttatccttacaggtaggccctatggacttatgccctaaagactgtaagggctaggcagcccatatgttcgtatgttttctgttggtataactgaataccacagactgggtaatttataaagaacagaggtttatttagctcacagttctggaggctgtgaagtccaaggtttacaggcaggtatctgttgagggtcttcttgctgcatcatcatatggtggaaaggcggaagggcaagcaagcacatacaaaagagggaggcaccagaggccagcccactttata

SEQ ID NO: 50633 - DNA, 252 bp, Homo sapiens
tgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccac

SEQ ID NO: 50634 - DNA, 425 bp, Homo sapiens
accccaaacgtctgactctctgtgggagaaaccagggctcaaagcaggagcaaaaaatctagtgctggatgcgctcgggcatcgagaggcatctcgtagagctggctccgagtttgaggccacacctttgcagaatgaggcagcatgtgagcgatttagttcaatgtaattgcagtggagatggacagggagaggacagattagaatgatgtttaagggatagaaataacaagtcttgcagatatattacatatattagttgaaccatggggaagccaaatgtgaattgtgaaattatggcagtggctggacacagtggctcacacctgtaatcccagcactttgggaggctgaggcaggcagatcacctgaggtcaggagttcgagaccagcctggccaacatagagaaaaccccatctctact

SEQ ID NO: 50635 - DNA, 407 bp, Homo sapiens
ttcattctcacaacttcaccacaattactcttcaggtccacattgcaaatccaacggtcagttgagagtcctcatcttagatgacctgtcagcagacttccacacagttgagcctattcactcaagtgctaaggctatgcacattcttctctactgacactcacttcctcgtgatcctgcctggcctcacgtttacaactccgaatatattctttccagcctgaactctcctctgaacttcagacccatacatccccaactgctgactcaatatctgcacgtggatgcctaatgcgttcaaacgtagcatgtccaaaagcaaattcctaatcctcccccttcaaaccttttgctcccatttgctcccacagccttttccatctcaataaatcaaaactctaatcttc

SEQ ID NO: 50636 - DNA, 323 bp, Homo sapiens
ctctgtttttgtgactttctaccatgaagttttataacagaagcacaataaatgttattttaaaataaaatatcactaaaatatagcttaggacttttttatgcacttagcccatctgaataaaaaaagccatataaacaaataccattcccaatgtaaagatagttttttcttagtaataattctaccgttgaaagaatacctggccagatgtggtggctcacacctggaatcccagccctttgggaggccaaagcaggcagattacttgagcccaggagttcgagagcagcctgggcaacatggcaaaaccccatttctac

SEQ ID NO: 50637 - DNA, 371 bp, Homo sapiens
ctgtctctaaaaaaacataataacaatagtaattcagtaacctgaacatatgtttaatatgcttttatgtatttgtgttctactgagcaataaaagttttcagcttgaattaatggcctcataggaagcatatgtcacaaaacttaaaccatcgccaattatataaaacttggcatcttcccctgatccttaacaaggcagatataaacatttttgtggatgttccctagtgtgtatcgataatttcatgaaaagttacttaacattattttcaataagcctttccatgcagcagtctagtttaacatttttaatgactaccatgtgaaaactgcctgtgtgtgcttcaccaacggtttttctgtgacttg

SEQ ID NO: 50638 - DNA, 382 bp, Homo sapiens
gagctaacaactgtctttggaaatttacatgtctataatgtcaagctgttatgtacagagaattgctttatgctgagatcataaaaatttttgttttcctccattctaatgtaaagcttgttacctaattgatcttcatttgcccgggttcccaacatacacatgctactttcctcttaagattgtcaagttataaataggagaacttttatttagaagaatgctaatatgaatcttttggaaatactagtaattagctttcttctgctgtctccaccaattttatctgatttagaaaattatatttcctttattgagatgcttaaatcggagggcttagtttgcttcagaaagtttataaactatattattagactaattt

SEQ ID NO: 50639 - DNA, 422 bp, Homo sapiens
gactttactgattgagaaaacagttttagtttagctgaggttgggaaagactacacaaatcataatgatgaagaactgtagcatgcatccagtgtgccagttttgaaaaagggacaggtgggaggtcattgaatgatgggggcaagtcttttctgtactgttcttgtgatagtgaataagtctcatgagatctgatggttttaaaaagaggagtttccctgctcaagctctctctctttgcctgctgccatccatgtaagatgtgacttgctcctccttgccatctgccatgatgtgaggcttccccagccacgtggaactgtaagtccaattaaacctcttttctttgtaaattattccagttctttggggtacgtcttttattcagcagcgtggaaaaccagacttaatggcaatttgcc

SEQ ID NO: 50640 - DNA, 421 bp, Homo sapiens
ttacaagtgacctttgcgatggaaagcatttggactttatagcatctagcaaatcgcaattttgtaccagagaaaatgccactctccttgaaattttcattgtaactaattatgttatattccatatgtttccatagccttgataataaaagaatggaactcagaggtcacatattccaagaaaaaaacggatacagatttagaaggaaaatgagaatgaaaatcacagccaattctcactctttagggaatagactcacccaataaccatgaattttgctgggtatgaaagcaaggagcaacaaaataataaattatgctctcttagaatgaaggtaaaataaactgttagaaatattttaaaagaatggcaaagatcaataaagcataaagaataaagggaaaaataaatattttgatg

SEQ ID NO: 50641 - DNA, 345 bp, Homo sapiens
gggacagtgggcacgtcccctccctgacggtgtcctcctgcccctttgtaacccttcctgtcactcttccctttccccagcccccatgagccactgctgacctgctttctaccgcatttctgagtttcactgtatatatggaaatatacagtgagtcttctttttcctctggcttccttcattcaggaaattctcttgaggttcacccttgtttgttgttctgtatgagtaactcaccccttcctgttgctaactataccctcctggctggctagaccagagcttgtttttaatctgttcatccgttgatgacaccctggggcatatccagggtttgggcaatac

SEQ ID NO: 50642 - DNA, 227 bp, Homo sapiens
gctccatcttccctttactttgtccccacatgtacagtaaaggaacaggcagcatggcactggtcaggtagagaactcatctgcataatagaagatcaggataggggtagccagcttttttgcaccctatgaaaatggcacacctggtccaaccaatcttctgtgccttatgtaaatcagataccgccacctcaagttcatctataaaatctcctgcacttcaccac

SEQ ID NO: 50643 - DNA, 456 bp, Homo sapiens
ctctgtgggtttctttcccaggcaggctgcctccaagtgggagcaaagtacctcagtagctgtaggcctaaaatctgccaggttagcaacattaacaacaaaaagatcttatttcccatcaattaaaatctcctgtctgctctatgaagcatctactgaaactctcactggctgtttttgggtcaccttcctaccctagagccacatgtggggtcagctgagctaatgtgtcagcagagagtgaagaaggtgggcctagaggataaatatagggcagtgacaaaaagaaaaaagcaaagcccctgagaaatgaggatgtatactttataataataaaagatacaatccataatgcatatctaattgttcagtatgtgtcaaatagcaacaatatatgtgtttagatacaacatcatggaaatacaaatttaaaaataaaaataaaaacataatagg

SEQ ID NO: 50644 - DNA, 441 bp, Homo sapiens
gcacacttatactttttccttggggtgcccatcttttcgcttgatgtgcctaacagggagaactctgcacacaggagattttcagttagtatttgtttggtgaacgaatcgtgtctctatggtaggtagtccggcaggggtcagaagcacagccctggagacaaacttaacagtttgagttctaatagctggctgcctccctgggtctctgttttctcacgtgaatcctgaggataataattacatctacatccctctgtcatgtaatgaatgaaaaagatgatgtgttaaaaaaaaaattaggatgctggtagctagtggtcagtaattgttagatcttatgacttctgctcttactgccatcatggtgagtgtgtttctatgtaaaaaagctaacaaccaacaaagggtgaaaattaaagttcaacttttgattattga

SEQ ID NO: 50645 - DNA, 618 bp, Homo sapiens
aggagggagtggaggaaaaggctggttacattcattcttgggcatgtacgtgcataccgtttatttgcaaattgaggtacttaagaaaattgtgcatgcaatagtcaggaactagtataaacattcagaagtcttttattgcacaatcaaaccttttaagaataagccttgtgtaatagggagctttatagtttttcctcatagtgaagcatgttgtgaagattttaataattgataattttttctatggtctttaattgtcaatcctattttcattcagttgttgttgctttttttaaaaaaaaaaacaaaaaacaaaaaacaaaaaacctttcaaactaggatgagcaaataaaactaggatgagacacagcttccctctctgtgaccaacgatgtcaaaaacccttgcaaagaatcaatcaacagctgccaggggaagaaaacgtggtgatctgagacttctcccttctctacaaagggacggttgcccgtctgggtgccaggtgttctgatagcttcagccatggagaattctgctcaagaacagcagctgctaagccaatcaggttctcattagccagtcgggagatggtataggtatctacggtcccaagaa

SEQ ID NO: 50646 - DNA, 262 bp, Homo sapiens
agtgaattcttgctttattgatacattctagtattcagttgtgattttaatatgctattttggtactttctgctttcagttttcattgctgtggctattgccttaaacagaaacaaaaaactaaaacaattttacaaccatccaaaagaggcttggaaacttttttttggctggatatccatagcacaatttaattcagtaaacataaacagttaaaattattccagtacacaaccatgttttaaaaaagagattacaccca

SEQ ID NO: 50647 - DNA, 1202 bp, Homo sapiens
tccagagaccacatctgcagctcccaaaacaaggtctgttctgcagctggacaattcactgctaaaatcccaaacctaagagcagagccaaagccagaggagaggaaagtgacaatagggccaaagcctcattccagattccaaatgtcattctgtagccctcgtgctatcaactgctgcctgctggctgcagccaggtccctgggtccatacacagcctgcatcaagagcctgcagagactcgggggctggagatgggaaacagatggtggcctgcgctttgtctttcccaagtttacagcctcacctgggggtggaggctgttctgaggggcccccaagaggcacgagcccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagcaaaaatcacagccagctgcatctcgtgggacctccaagctcctctgactgaacctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccatt

SEQ ID NO: 50648 - DNA, 1148 bp, Homo sapiens
tccagagaccacatctgcagctcccaaaacaaggtctgttctgcagctggacaattcactgctaaaatcccaaacctaagagcagagccaaagccagaggagaggaaagtgacaatagggccaaagcctcattccagattccaaatgtcattctgtagccctcgtgctatcaactgctgcctgctggctgcagccaggtccctgggtccatacacagcctgcatcaagagcctgcagagactcgggggctggagatgggaaacagatggtggcctgcgctttgtctttcccaagtttacagcctcacctgggggtggaggctgttctgaggggcccccaagaggcacgagcccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccatt

SEQ ID NO: 50649 - DNA, 346 bp, Homo sapiens
ccggtaccagttcgacggagactctctctgtcatcagctgcttctcctctgactgactactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccatt

SEQ ID NO: 50650 - DNA, 409 bp, Homo sapiens
gaaatgaaaacatttctagcaatagctgctcttattttggtgccaataattgtcacacatctgtgtaaccacaaatcatgtgaatgaatcatttttttaaatgattgaataacatcatctatgctttatatattttttcagagcagatttactatgctgggcctgtcaataatcctgaatttactattcctcaggtaagatattacttacttcttgtattaaatagtttgtttcttgaagaagaagaagaaggctagaaggaggagggaaaggaggagaaaccaagaaagaagagaaggaaagaattaaacagtttaaaacttatccataggccatccctgcaaaaaccctttcttaataaaactgctgcttcagagtgggcacttgaaatttcttgacacactggctt

SEQ ID NO: 50651 - DNA, 417 bp, Homo sapiens
tggtaggtgtagatcaggaaatgaaaacatttctagcaatagctgctcttattttggtgccaataattgtcacacatctgtgtaaccacaaatcatgtgaatgaatcatttttttaaatgattgaataacatcatctatgctttatatattttttcagagcagatttactatgctgggcctgtcaataatcctgaatttactattcctcaggtaagatattacttacttcttgtattaaatagtttgtttcttgaagaagaagaagaaggctagaaggaggagggaaaggaggagaaaccaagaaagaagagaaggaaagaattaaacagtttaaaacttatccataggccatccctgcaaaaaccctttcttaataaaactgctgcttcagagtgggcacttgaaatttcttgaca

SEQ ID NO: 50652 - DNA, 1566 bp, Homo sapiens
tccagagaccacatctgcagctcccaaaacaaggtctgttctgcagctggacaattcactgctaaaatcccaaacctaagagcagagccaaagccagaggagaggaaagtgacaatagggccaaagcctcattccagattccaaatgtcattctgtagccctcgtgctatcaactgctgcctgctggctgcagccaggtccctgggtccatacacagcctgcatcaagagcctgcagagactcgggggctggagatgggaaacagatggtggcctgcgctttgtctttcccaagtttacagcctcacctgggggtggaggctgttctgaggggcccccaagaggcacgagcccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagcaaaaatcacagccagctgcatctcgtgggacctccaagctcctctgactgaacctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccattaaaaaaaagaaaaacagaaacaaatacaacaagacgagacaaaacgaagacacatgtacaaaagcaacacaacacacacaccaacgacagacgaatcaattaatcctcagaaacagaaccaaccgcacaccacaacagcggcaagaccaagatcagacgaacatcactgagaggcatgcatgataacatagaatccacaagcgacgaaacactgaaaaacacgcgtgaataaaacacccgaccgctgcccaaacataggaagcggcaatcagcccgcgcgtggaaccgagacaagtaaacaagacgccagatctctgagatcaccgacatcatgacacagacacacatacgaatcacatctgaa

SEQ ID NO: 50653 - DNA, 519 bp, Homo sapiens
ggaaagacattaaatagggacaccataatgtttaactggtataggtgctgaaggtctagttatcaacatctatcagcttgtctctgtaggtgggcaaactttaaataactagtttttgtaccctgattttcttttcctcttaaagtagatactcattcttgaagacaatctgtttctttcaatgctaatgtaagtgcttataaccacttgtgacatgttctctacccaccgatccactaaaaatgatgagagtttcgaagattcgggtcatgtcttagttgcttcttcagagcctagcctggtcccatgatgggtgcctgttggttgctgaattgaaagcttctaggctgggcatggtggcccatgtgtgtattctcagctactcagcctacttaggaggctatggcaggaggcgcttttgagcccaggtgtttgggattttagtgtgcaatgattgctcctgtgaataaccactgcatctagcctgggtgacatagcaagacccatctctatgtaaaa

SEQ ID NO: 50654 - DNA, 347 bp, Homo sapiens
tgggataattatttctcttcaaaatatttcataacataataaagataagctctgaaggatgacaatatttcatcaaaaatagctctatgacagatcatcaaagaaagactcatgacccaattctttatacatgatgccagagaatcagttcctttctgtcctggtttagactctggactgcaagataactcaggtcttttagatctttcaaaatatttataaaccaaaaaactattcccttgcgtaaaatatttccagccctgttagagttggagagctgacattgataaaacactgggcaagttaatgagtattatggttaggtgtctaccggtgtgcagacctgt

SEQ ID NO: 50655 - DNA, 608 bp, Homo sapiens
ctgggtcatgtcacagttacagtaaatattatgtaaaagcattcaaaatctctgccataatgaaacataattagaaatcaacagcaaaaagatccctggaaaaattcctaaataattgggagccaaataacacactccaaagtaacttataggtcaaaggggaaattaagagacattagtattttgaacttcatgaatatgaaaacaataacatttcaaaattcatgtaatgctgctgaagcaatacttacatggaaatatacaggacaataaaatgcttttcttttaaaatgcgtagattttaaaagtctcaaatcaatgccctcagcttttatgtcaagaaactagaaaaagccaggcatgggtggctcatgcctgtaatcccagcaatctgggaggccgaggcaggtggattgcttgagtccaggagtttgagaccagcctgggcaacgtggtaaaaccctatctctactaaaaaattacaaaaaaatcagccagccatggtgcctcacgtctgtaatcccagcactttgggaggaggccaaggcaggtggatcacctgtccaagacaggtcaggagttcaagaccagcctggccaacatggtga

SEQ ID NO: 50656 - DNA, 253 bp, Homo sapiens
ctatctgaaaattatcagtgagagattctaatgtgccttaacaaacaggaacaaaagatgagtgtttaatacaattcaatttaacaaatatttattaagagcctacagttattcccatggatcatctgagtcagtttccgaggaaacattatcgttgccttaagggagctggggggttgtcaacgggccagaggtgggatgaaaaatgacaacagatttacctctgggaccgggacatggttaaccacagcgg

SEQ ID NO: 50657 - DNA, 449 bp, Homo sapiens
ttgttttgtatatatatatttttgaccatgcctggtctggagataacattttcaatatagaaatatcaaacacaacaaaagtgaaatctagcaatttcacaaagtttaggatacgacaaatttctgatttgtgattataaattgtctccagacaatccatgacagctgacagggaagcaaaaggaagcaaaaggtccctcagagatttctggggacctgccaagtctcacaaggagttctgaaagagactcaggctcaggctgcagacctgtggggcaccctccaggatggtggccgccacccccaggccatcctgggacacagattcatcaacacacaggcaaacagaacagctgtccatcttcacctatcttctctctactaatccaagagacagcgggctgcctacattaactatgccctcgttggccaggcacagtggctcacac

SEQ ID NO: 50658 - DNA, 485 bp, Homo sapiens
aattgcaattagggaaagctataaagtcaggacaaacagaagaaacttagcagtgagcatgaagtgagcgcctcctaggtgtgaggctggtacctgttaccatctccattttccagcgggggtccccatgtgtaggaatgttgagtcacttgctcagggccgtacagctgagccaggtagagctggggttccatcccatgtttaaccacagaacctgccccaaaccattgtgcaatactgccgcattctgaagcatgtgtaaaagctttccagttgggcaggtctgtatataagactcagttaaagttaaaagataaaataaggtcattgttaaaaaaaaaaagccactatttagtggtatttagtcaactatctttgccaaaagctggtgggggtgagggaacgtgtgagagcaggtcctggaaacatccttgatcattgtcagaatagttttgtatgaattcatacaataaaaaatagaacta

SEQ ID NO: 50659 - DNA, 366 bp, Homo sapiens
ttagttatgagagcagtaagcataaggaatttaatcctaatttcatttctgcatttatttaagcaacattaaaatagaaagtgattaaattagtttttaaaaattctgttatgatagaaccagaatttgcaagcttgagccagcttacttaatattattgctggaaacctagcatttggcattaggtgactggaactgggactgcagttttgtatttactaggttatttctctatttatgaaatgggaaatatatttctaactaaaagggtcgttcatttgttcattctttcactcaacagataattagttgtgtagcaccacataattttatctcattactagtttaattttccctactgtcaaa

SEQ ID NO: 50660 - DNA, 393 bp, Homo sapiens
aaattattaattatatgaaaatgctcataatattacaagtaaagaaaaaagtagaattgctagaatgattctggaagaatgaacatgcaggtacaaccaaactaatgtagaaaccaaccaaacaaccaaacaaacaaaaaaccagaaaagaaataatgaggactttccataataccagaaacgatatatatcataattccaataattaacataatgctggcaaaagaatatacatcaattaaaacagaagaggaaagcccacaaacagactcagtgcagtataaaattgaaagtctctgctgggcgtggtggctcatgcctttaatcttagcaccttgggaagccaaggcaggaggattgcttgagctcttgagtttgagaccagcttgggta

SEQ ID NO: 50661 - DNA, 396 bp, Homo sapiens
gaggaataggtgtccctgggaacccaaacatcctggagaatagctgagaacctaccaagggaaacagtcccatcacacacacatagtaggtaaagagacagaaaattagcttagagatgggaggtggcacggatctctaaagctgtcccgctgccattcaggagtgcctcatgcataagtcctaataaactcatctactagccaagctgaacttgtcccagacatgcttggtctctttgctccctcccagtttggggtaaggttttttttaaatacaattccaggtttttctcattacaattgctgtcatgagcaggatctgagaaaccaatggatgaattaggaaggcgcatctgcggggagaatcctagggtggttggcaacatgcatgtggcg

SEQ ID NO: 50662 - DNA, 636 bp, Homo sapiens
gtttacgttgaagatgcattggtttttgcttattcttaaagaaaagattcaggattgtgaatttgtgactgcagctttaggcgtatcccaaggttttcagtactagtttagtttttgttgtttttgtttctaattatccttttggcatttccttatcaatataagactttttaaaattcaagtgttttgattcattttatccaatttttggttactaatttcttggtttctttgtgttgtggtcacatcatgtggcttttacacacattttctctgttttggggatttgcttacttttttttgtagtcgtgcaagattttttgtgaaaagaaaaactgtatcaagttcatcacctttatcaatttgacctgtgccgtgaacttctttagattcatttgattcaaatggatctaagtattttaaacatttagaatactaatttaagcaaggcttgaaaattaaatggagtaaaagcaataaaaaaatcaatattagcctgggcattggtggctcatgccagtaatgccagtactttgggatgccaaagcaggaagatctcttgagcttaggagattgagatcaggttgggcaaaaacatgaaaagactaaatcacatctctagcaggaaaaaaaaaa

SEQ ID NO: 50663 - DNA, 986 bp, Homo sapiens
gcactttgtttccagggtgggcccctcactgagaaagcctggtcccctggagtacttgctactgggcctgcatcctcccccgtttgcctacagaaataaagttttagatgtcactcactgatcagattaaccttggaaggcatcagattcttcccatggggtctccgcgcttaggcctggaagccccatgttcctcatggacataatttgttttgtttgcacagatttgaattagttatcaccatgtaaaagccagccatttaaaaataaaaattcagatttctttaaaaccagaagttctggtgcccctccattgcctgcccctttccccaacaccaagggaggaaagcgggggttttctgtttagcattgccattgctgccgttgggtttcttgttcagtaaaaaggcagagaagtgtgttaaatcaagtttagcctagagctacctccttagatattttaagttcagcctaaaggtttttctgtatatcatgaactataacaagtggaggtataaaaacactgtagactgcacttgtgccaatcaaatgtagccaactgttcgaatcttgttcaaataaggcaaaggagctgtaaccaatccagctgtttctgtacctcacttctattttctgaaagtaggtagaaattaatttacttcgaaaaaaataatttcccctgaaaggtagctgctgtatcccaaggctttgccaggttaacaagtggacagcatggaatatttggaggaggtttggaatcgtgcgcacgtgggtttcaattctgctcagccacttgttaagctgtgaagtctctgagcctcagtaagatggacttaactccatctacttgcggagttgattaaagataaaataatgtatacaaagccctaggcatattgttctggcaaatagtttgtaataataaatgtagttactttgagaacttgaaacttggtatgggtgaggaggagatgaataaaaagaaa

SEQ ID NO: 50664 - DNA, 340 bp, Homo sapiens
tcataaaacatgctttgtttttaacaaatggtgaaagattaaaaatatttgttttctcaagttgtatatgttttttaaaacttattttattacagtagtaacttttaataggtagtaaataagggcaaataggcgatctattgagtttctccttgaccttgaagtaatacttcaagacgtcataagagacattgattcctcttgggttacaaagattgctagtagcataggctaccataatctactatgcttattttctctctgtaatagcacatggatttcaccaacagctttcacagagattctacacctttttggtcacctgtcagtgcctgatagc

SEQ ID NO: 50665 - DNA, 384 bp, Homo sapiens
aggctgcgggagctgtcccgggagctgtcctgtccggtggccggctttccaaagtggggaacgagagatgagggagggagcacttccaggcgctgcgtggtggccaggcgcccaggaagccgaggggcccgagactctgcagcggggccagaaagagaagagtgggggaggaggccgggagtggtgcatggaccagggggtagagggaggtgggtgtggacctggggtcgggcgccagtcagcttgcagcctatgaaggacggaaaggagggctacagagataggggaagagtggggctgaggatagccagagcggcttggcacacagttttagggtaaaagcatcaactcttatctttccaaaagaaataaaaaagccaaaaa

SEQ ID NO: 50666 - DNA, 200 bp, Homo sapiens
cttgcctaaggttgtgcagctattaagtgacagagatatggcatatgaaaccaggcagtcttactccagtgcctgcactcttgaccactctcctgtatacctcacacattccatgtttttcattacacttttagtgcactgcctagattgattgattcttgccttcattctctcagcaaatatgttagctatgtcccagg

SEQ ID NO: 50667 - DNA, 1144 bp, Homo sapiens
aactagacaactggggaatacaaaaccaaattcaactgattaacagttcaaagctaaatggtaaacaggccaagccaacattcgtctaactactgaacaccagcactatattctgccctttagaaaacaaaaaataacatttaaaccctcacctccatttatctaacaatctactgaggtagagcgggagagtgatatacatatcattataaaatagtgggttctcagccttctgagatttttgacaattcaataatgatcttgaagatctctaaaatgtaatcacaggttattctgcagagacactaatttcaaaatatatgtattaaacttaactattggtgacggagcatctttgttattctctcctcacactcccatatgcatttaacagagaaataatactgtacacaaaagtggtatttaggacctcaaacttttcctcattaacacaagatctaatgacataatttagtgtcaaaataaaaatactgggggagggatgtataagtgaaataaacatccagttagaaaccacaagcataaagtttaataagaaaatgtaagtgaaatagactgggaaaagagcattccagttacagctatgattccgcttccaggctatttacatttataacatactcatcaataactctctctttacagtgatttacaaaaagctaagaggtggctatttcccaatggaaatgcattagaatctcaaaagaactctgtgctttcctactacaaaatcactgagttcctaaaccaacaagacacacaaatgggaataatgggaatatatagtgcacagctttgcatacagtaaatcttcccgtttcacagcatctttatatgcgatgtatataataagcatattcctatttacagtcttataaaataatcttatgtaaagtctcaaatccatagctcaggaacctgtacagctgaaggcaaggggaaactgaaaggtttttagaaatacaaaatgattcaagcaatatcactattaaaactaatagtaataaaaattaatctaataatctgggtcaggcatcccagcactttgggaggccgaggcgggagggtcacttgaggtcaggagttcgagaccagactggacatgacaaaaccccatctctac

SEQ ID NO: 50668 - DNA, 366 bp, Homo sapiens
taaattatttatttatttttgagacagagtctcattcaattgctcaggctggggtgcacagctcactgcagcctcgaactccagggctcaggtgatcctcccacctcaaccacccaagtagctgggactacaggtgtgtgccaccacgcccagctagtttttttgtagagatggggtctcaccatgctgcccacgctggtctcaaactcctgaccacaagcgatctgcccatcttggcctccccaaagtgctgggattacaggcatgagccaccacacctggcctatacccatttctgtaaaggacaaagcatggtattataaatagtatgtcctggttcacgctggagtgtcttgggttcagaca

SEQ ID NO: 50669 - DNA, 2790 bp, Homo sapiens
tgaaaatgtaggagccacacgtcttaaagcaggcccacaggaacccagcaacatcaatgaagagcaggccggtgagggctggggcagatgccactcatcttccagtgataaaacagattgtctagttgttcatgaggagccagaaatctaaatttttatgagaaatctcatatttgcatggtcaaagatttaaaaaaatttaaataccagtaggcaatcaaaatgtatctgtgggctttccttagcccaggtgctggtaacccctgacttctgctacaaagagggattattctgtctatatacgaggctgagaagtgagttagggcaacatagtaggtaactggggtggattcatggttaagagcaggaagagcaggaagccaccactgttctccccagagtcaggctgtggactgaaggagatttcaaggttggattctggttcagacaggaaagctgcctggagaagactttgcctttatgggtcactgagtggggaccctgtgtgggagccctgcccaggtgaggtaaaaccttgaaagatccttctgtgaggttagctcccttttctcttgagggagctagtagcttgagagagctagtttgtctggcttctgtggaaggctgtgcattaaacagcaacaacaacaagaaaaaacatttacagttcttcctgagtttaagaaaagccagtatgcccataacagaagggctgggaacatgtaaggaataagagtcatctgaacaccagcacagttattcagtatagtgccttctagtcataactagatggtattaataccattttaattcttgcctttttctcacttgatatttgattgatggtgtttcttgtgtgtgctgatttgtttgtgactactgcctgctggagagagcctttgttgggtgttcccctgtgggctggaagtcactggtatgcacacccttgccttttctttcccctggccattcatctagctactctccttttctcttgtcccactgtcaaagtgcttcttttttttggccaagtaatcagtctcgatggaagccaaccaagctccccttttattttgctcatttcttggggtttcctcctgccatgccagggtaggaaggtcaaggtcatctagatctccaaagagcagctgggctgaggaggggtactgaggccagcagcctggcctgcgtgtgaggtattaagacacggcagacacacagagtggctgcggttatccttgcttccccttttccctgttgagaggtctccatgtaataatgcctcctttcttctcttgcagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacaaaaaaaaacaaatgaaaaataagagagaggaaaaaacaaagagcgaaagagaggaaaaacagaagggggggcgattttggggaagaacgccaattataggcgaagggagataagagagggaaacagggaagtgatgtggacttgaggaacagaacgaattattagtggtacattataataagagaaagataaaggat

SEQ ID NO: 50670 - DNA, 3617 bp, Homo sapiens
ctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagcagaaggaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaataca

SEQ ID NO: 50671 - DNA, 2593 bp, Homo sapiens
tgaaaatgtaggagccacacgtcttaaagcaggcccacaggaacccagcaacatcaatgaagagcaggccggtgagggctggggcagatgccactcatcttccagtgataaaacagattgtctagttgttcatgaggagccagaaatctaaatttttatgagaaatctcatatttgcatggtcaaagatttaaaaaaatttaaataccagtaggcaatcaaaatgtatctgtgggctttccttagcccaggtgctggtaacccctgacttctgctacaaagagggattattctgtctatatacgaggctgagaagtgagttagggcaacatagtaggtaactggggtggattcatggttaagagcaggaagagcaggaagccaccactgttctccccagagtcaggctgtggactgaaggagatttcaaggttggattctggttcagacaggaaagctgcctggagaagactttgcctttatgggtcactgagtggggaccctgtgtgggagccctgcccaggtgaggtaaaaccttgaaagatccttctgtgaggttagctcccttttctcttgagggagctagtagcttgagagagctagtttgtctggcttctgtggaaggctgtgcattaaacagcaacaacaacaagaaaaaacatttacagttcttcctgagtttaagaaaagccagtatgcccataacagaagggctgggaacatgtaaggaataagagtcatctgaacaccagcacagttattcagtatagtgccttctagtcataactagatggtattaataccattttaattcttgcctttttctcacttgatatttgattgatggtgtttcttgtgtgtgctgatttgtttgtgactactgcctgctggagagagcctttgttgggtgttcccctgtgggctggaagtcactggtatgcacacccttgccttttctttcccctggccattcatctagctactctccttttctcttgtcccactgtcaaagtgcttcttttttttggccaagtaatcagtctcgatggaagccaaccaagctccccttttattttgctcatttcttggggtttcctcctgccatgccagggtaggaaggtcaaggtcatctagatctccaaagagcagctgggctgaggaggggtactgaggccagcagcctggcctgcgtgtgaggtattaagacacggcagacacacagagtggctgcggttatccttgcttccccttttccctgttgagaggtctccatgtaataatgcctcctttcttctcttgcagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaataca

SEQ ID NO: 50672 - DNA, 3622 bp, Homo sapiens
ctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagatgatgaaccaggtggaagggcagcagaaggaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacaaaaaaaaacaaatgaaaaataagagagaggaaaaaacaaagagcgaaagagaggaaaaacagaagggggggcgattttggggaagaacgccaattataggcgaagggagataagagagggaaacagggaagtgatgtggacttgaggaacagaacgaattattagtggtacattataataagagaaagataaaggat

SEQ ID NO: 50673 - DNA, 2243 bp, Homo sapiens
caccggccctgaggtgcatgtatctcaccaggccggcaaagaatggacggtccttcaggtcaacgtagtgttccttgagaagatcttcggaagcatcgcatgaatttcagaccgacaaggtcggaatcacatttctgcgtcagaaacgcattgataatcatctccgcacaagagccccgcatggaccaccatctgggtattcgatcagcaaagtgaaagtgacgctcaacaagttcggccaatggcttccatgtccaagctgcgattatggtcttgaacatccgcgcatgcagtcccgccagcaacgcacagaaacgcagccacagggaccctacagtggttcagcagcctgcgtgcacagaattcaggcacagagggcaagttcactgggcatgtgccgctgggggtctctagtgataggggaagcgtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaataca

SEQ ID NO: 50674 - DNA, 3425 bp, Homo sapiens
ctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagatgatgaaccaggtggaagggcagcagaaggaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaataca

SEQ ID NO: 50675 - DNA, 2642 bp, Homo sapiens
tcctgtgggcttcactgagatcttcccaaccatctctttagaattggggttatttagagctgattgagaacaccttaggagtatgtctgtggaaaacgtctatttacgttgaagttttaaaaatgcctaccccaggagggaaggaacaccgttattacctctctttggaatgttggaaaggaatggtccgtgtggccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaataca

SEQ ID NO: 50676 - DNA, 1267 bp, Homo sapiens
  misc_feature (989)..(989): n is a, c, g, or t
ctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagatgatgaaccaggtggaagggcagcagaaggaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccagaactcanggctcctgaattcggtcttcgtcctgaacgatgacaaacaagctgacaatcgacagatcaaggcaagagaccggaacttgcggcgtcatcggacggatccagcgtacgtatacattcgttcatcgtcatcttcacgaacgtcaaaacttcggcaatggcacttcgacgcacaggtgcgtgctttccacaccgttctatccctgcgacgaacgcgaatcgtttgcctggcagcatggctatgccagattaacagtcggcgacaccccagcaccgtcacg

SEQ ID NO: 50677 - DNA, 586 bp, Homo sapiens
ggccgaataggaacagctccggtctacagctcccagcgtgagcgacgcaaagacgggtgatttctgcatttccatctgaggtgaagacaccatgttcctctactgttgtggatgcagccctcaccagacgaccgaacctgccagtgccttgttcttggacttcctagccttcagaactactgtttgacctctggtaactaaaactgcagaaggcaaaactggataaggagactactgtaatgattatgctattacaagacgctcgattgctaacatcagacatttttataaaaggccagaatcctgctaggacatctctgcctgtggaaggagggctggatggcatactgggaatggctttctaggatgacttcctgttgctacagactacaagaagcatttctggccttgatgttgtctgaatgaagaagacataggagtttcaccaaaggtaggatcctgattgttacacgaactgtccacctccatccagagccgtgtggcttgtagtgccttctcgtggcagatgcagaaaagggcaacctgtatcccaaaggtgaaatcaataaatgcatgaaaaaaatgc

SEQ ID NO: 50678 - DNA, 478 bp, Homo sapiens
gtgggagctgactgtcccctgggagtaattctgtgaccataattagccacacagctcctctggaggcccctctaaaggacccccaagcttgggcacatgacccaaggtcagccagcaagatgccctgtcccggaaatttacatctgtgtatgagccacatgagaacagggaagcttgcagtgagagcacagcggttttcctggaactgccccacaaggctgtctctgagccccttttgctgggtccccagagctgctgtggctcccattcttcctgaggtctgagattccatcttccttcagttctgtaggatcctgattgttacacgaactgtccacctccatccagagccgtgtggcttgtagtgccttctcgtggcaggtatattttcctgcctgttcacgtgacttgtgttggccagtggaatatagtttgatctgcagtagtttgaatctgaggatgctgaacctgtggataa

SEQ ID NO: 50679 - DNA, 431 bp, Homo sapiens
agaaacaatttcctaagcgttcactggagatgtttcgatgctggcagcacagggtcttaacagcgaagacgtcggtttctgcttaatttcttcccagcctttttgaatttcaacagactgagcagatctgtcccttaattttagggtttttggtctttgcttgcggttgcaagaaaagctgagttttgactaacttggaggcatttctaaattcttaacatacaacgattgcattaggtttattctgaaactataaattgaagttgttctttttaaatgtaaagctcatgtgtagtaaaacagtgcttgagaaaaacatcagaacacaacactgaagggttgcttcttttctcaagtgcaaatggtaattaaaatttaaatggtaaagattgtccttttcataccatctattgcagtcatttacaatttta

SEQ ID NO: 50680 - DNA, 716 bp, Homo sapiens
atggatagttttgcaggccatgatgtgcagtgtccctttagcagtcattaactcacagtgagttatcaatgggtgttagttctctgtgggtctgacaacttagtatagtgaaaagagtgctggcctgtggctgaacatgctggagaagagcttgcctggccacagggacacagccacgcagatccagcatgtgtctcccatgtgccaagtggagcccccagccaagaaggcagccacactagcagagggtgacaaggacaatgacattgacctgtttgtcagcgacaatgaggaggaagacaaggaggcagcccggctgtgggagaagtggctgaggtggtatgtggagaagaaggccaagaagactgcgttggtggtcaagtcctccatcccgctggacatcaagccttgggacaatgagaccaatatagcccaattggaggcctgtatgcgcttcatccagctggacgggctggtctaggggggcctccaagctggtgcccatgggctacggtatccggaagctgcagattcagtgtgtggtgggggacgacaaggtggggacaaactttctggaagaggagattaccaagtttgagagcgtgtgtagagtgtcgatgttgcagctttcaacaaggtctgaagccttagagtgtgtgtgcgtgcatgcgcacgtgtgcaagtgtgtgaggccctgccactattaaaaactgaga

SEQ ID NO: 50681 - DNA, 742 bp, Homo sapiens
gatgtgttctcctgcatgagctccccagacgtaagctgaactctcttgctgcctctccctcccttgcaactgtcatttttttaacactgaacgttttgtttttctaaagcaaccttatatgaagtctgcatatataaaggtgaaagcagtattttacagctataaacagcaatccaaaagcacgacatttacctattataaagtcaatcagtgaggataatagggctgttggaataatcctgacaaagtgaaaagtagatgacagatcatggtgatagtctcatgtcagcttcagaccccaggttatgcctatattttgtttggttttgtgattgtgaaaaaaccctagttactgctgatagacaactgcaaggagcagcagagctttccctctcttctgtacatcaggtacaatccaaggatgctaggatccttggaatacagtttgaaaatcacagaagcatcttagtgctatttagacatctgtcttatctgctgtgccaatgggcctcctgagggcagggtcagagacccaggcaggatctgagtcccttggaggcccctaggacatgtctgctggatggaggaatccacccgaaggtcccagggccatccccagaattcagactttctgggctcccacattctgataaggctgatttgctcggccacaagactcacaggaaagcccaccaaaaaagcaagagcagaaataaaggcagctagaattggggcagaaaag

SEQ ID NO: 50682 - DNA, 535 bp, Homo sapiens
attaaccttaattattttaattagctattatggacatttggattttgtgggtggagcactgaaaaaaactatacatctttcaatatttgtattgcttgtttgattttcaaaattttattacattagctacactatttaaaacaatgttgaatgatagggggatatccttatcttatttctgattttaatggaaatgtttgcactacaccaattattaataatacgatatttgctattaagttttggtaattttcatatttcagttctttgtctcttagagttttattaagaatacttaattttattaactggcttttgacattgatgtagacaatatgttgatgtaatgaatgttacagattatttttcttatgttattggaaaacattttaatcatgatgtcttgcttggaacttctattcttgaaacacaaagggcagtagagttctatttatacaatttactaattatgtttcttccatctccaaaaggaaattgagtttccttacaataaaagaatacattaaaatagaaa

SEQ ID NO: 50683 - DNA, 385 bp, Homo sapiens
aaacagagactacggactactttgtatcccagcatgtagggcagtgcctttattgatttcttagttgaataacttataatcttcccatttctgtatttattttcttcctaaaccgcttaattatcttggtgtttttaccctcatgggcctttgataagaagacgagctgtgtgggggaaatcttttctaagctgcaagtaaaggagtgttttcattttcttaaatcagacacttgtgctatcacctttcattgcagtctctctggcctatgagaaaatgagacattgacatttataagaaaatattactaactatgcttctttcctgaataatgaaaatgcatcttaatgaattatttttctttgttacatgttttctcacaaca

SEQ ID NO: 50684 - DNA, 463 bp, Homo sapiens
catgtataaaataccttcagctgaacacctggaatagtgtttaattgaattaattgttactccttcgacttaagtatctggcttaagtacataggatattggtattgtgtcctagccaaattgacacaaaagtaatcattacacccaggtttctccaaatgttgtcattttacatttgtttttaccaaccccagctgtcctccctctttttatcttgctaccctgcctcccacacacacaattttctgaattctttggaagtaatttgtaaacacaatgcccacttatccctaacaatcaaaaaattatccttgaaacaatactcttatttaatctacaggtcttttcaaatttgtactgttctcccaataatacctttgaattttaaatccaggaggctgtaaagtagcaaactaacgccaactgaccagatttgttccccacaacttttaactttcttaac

SEQ ID NO: 50685 - DNA, 329 bp, Homo sapiens
atataagtatgtatgtgtgtgcgtataagtaaggtggttcatgtgagcatgtcctctcctcagcactccacttaccgactgctcaaatgaattaagatgtctcttcataatgaacacatgcctcttaccttttgacagtttaactataaaaatttgacttcctttatttcttttgcaaattagggttatacttaaaactttaaatattatttgtattaggcaatttgattatgatatgccttgatacagttttcttcatgatttttgtgcttgaagtttgttgagcttcttttgtctgtggattgatggtttacatcagatttagaaaa

SEQ ID NO: 50686 - DNA, 416 bp, Homo sapiens
tatctcaaaaaaaaaaaaagaaaaaaaaaaaagtagagattgcattagttccatatctccgcagagttctctggtagattaaatgttctctgtgcactaggccaaggaagttcctgttacctttgaaaatcattgtgtttgctctgattgtctacattagctcatatcagtcttttgaacactggttcaaatctgggtgttgggttaggatctgatgagtagagaatagtggaaagttgatataggaaggtatactggtttctggtgtgattctttagctacatttattccttgtcttatgtcatttcactggatcatgtaactgtcctggctttcagaaattatattagatgcccagcctttctcattcagagatgcctgtattattatgttatttcgattgcctaccaaaaaaa

SEQ ID NO: 50687 - DNA, 262 bp, Homo sapiens
gctaagtgcaccccaagggaagctttgggagcacaaagcccatgagggaaggtgagttttgagggaggagtggtgaggcacctgtcacagaaaaagaaaaaaaaaacaatacgcgccacggagaagcagggcctgggtcccccacgatgaaaatgccttcccatcagctcctgctctgggccctgtggaccctggagaccctggttcgagccacgggtggcctcgggccgctaggagtaccccccgtgcgcctctctgcgcc

SEQ ID NO: 50688 - DNA, 695 bp, Homo sapiens
aatgagctaatgagagagtgagcaagaggtggcttgattgggcgccctccttcccagtgcccggtctgtgatggcctcacatttgacctctaactgtggctcacactattcactctgcttgcattgctctcttcttcactcctgcattgcttcactaaaccccagccctaccaccttaaaactctactcacattttaagtctccttcaggatgccttaatggggtacgagttctttgtctgaaggctcacagcattcagtacttctaaagttgtcttttttcctctctcaagagagatcccaatatcgtcttctcttccatttcctggtcaaggatagcactaacacctaagtatttccaaggtgggaattgaaagaggcctttccatccagcctgtattcctgtccccagacatgtgccagacctgtgctaggatggctgaattaaatggaacaaatgataacattagcatttgaatttggaatttagggtcaggatggttccatagaagctgctatagtttggatgtttgtcccctccaaacttcatgttgaaatttgatccctagtgttggaggtgaggcttaacagggggtgtttgggtcatgggggcagatctcttgtgaatggcttagtgtcatccttgctgtagtgagtgagttcttgctttattagttcccacaagagctgattgtt

SEQ ID NO: 50689 - DNA, 439 bp, Homo sapiens
cattttagagaatccatattctataaccatgtgaacaaactgcccttctgaaaatttataataatttacaaatctcttccctcaggagtgtgtaacactgccgttcctgtgacagcctctaccaaaaaaatttttttaatctcttctaattgagaatacaattttaattggcattcattttactaataatgtcgaattgtttttacatcttatttgctggcatatatatatgctttttaaatggacataccaaagtatgtttatccaatgtatgctgctcctgtgaaattagtcccttcggaaggtggtgtctctattctagtgacgtgaccttcccttaaacatttggggtaactcttctttttgagtgaccatcaggggctttagtgacattcttttgggatagtcttagggatccagttattatcatcaagttggg

SEQ ID NO: 50690 - DNA, 632 bp, Homo sapiens
aaaatgcacatttcctgatcttttcccagagtttctgaatctgttggtctggggacaaggtccaggaatctgcagtgtcacatgcacccagggcatgttgacgctgtctctctgaggactgctctttgaaaaacaggcttatatcacaacaagaaggaggctggcccactagcttttaagtatttagctgatttcctgctgaaatagtgcaatgtggttaacagtgagccttggaagagatgagtaaaggtgatgcttcaaagacatgctgagcaaactgaaaagcaagttaaagcgccgtgacattgcttccaaaagccaaggattgacagcagctgacagtcatgctggtacctgtgtcacctttgaatacaaagaacattgggcattttgacttatttcagcagggataaaatgttagggaggaaaatattcccctaactgccttcctcctctgaaacatcaatgtagaataataatgccttctactcatgtatcagctttccaatcaccaacttatttgaaggcatcacaaaagagaccttttaaatcatctacccttaggcaaatagtacatttcttgaaattccttgaatgttgaaaaatgtacttttgaaaaagacattccaaga

SEQ ID NO: 50691 - DNA, 3173 bp, Homo sapiens
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactt

SEQ ID NO: 50692 - DNA, 3020 bp, Homo sapiens
ttccagtgtataccgatgggcgagtgcatcccgtaagcatagtcttatgctgtatcccagggtactcatctgatctccgtgttgtacctcggagtgagagacatcatcttgttagatatcatctcagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggttt

SEQ ID NO: 50693 - DNA, 3240 bp, Homo sapiens
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggttt

SEQ ID NO: 50694 - DNA, 3233 bp, Homo sapiens
agtcagaaggtttgagggtcaaagaattgcttaatcctgggaggtggagttttccagcgatgcaagattattcccactgcactctagaattgggcgacagagtgagtccgtcaaaaaaaaagataaaattgttattttaagcagatgttttcataggaattggaacttatccttactagacttggattcaaatcctgccttggatacttacgagccatgtgatgtctggtgaactacttgaccctccaagccttggtttctttatctcccatcagtaaacaagttcaccaaagctagttacaacttgtttattgatgggagaggaagaaaatcaagggtggaaaattgttctaggcctaacctcaagtaaagggcagatgtcagaaggagaagggaacagcatcactagatagagaagacttcagcaatttccaaggagaaatcctaaggcataagtaaggctctctcttttaagtcatgttattccatagcaatggaaggaacaggccaccgtacctggcctgttaaaggtatgatggtaaaggtgaagtcagctttttctagcttacagttctgtcatccagttcctgagctaaaataggcgctacacttctgattttggctttgtcatttgagtctctggctcttttctgtatgggtcaagctagaaggaaacgatgcgatgcaggacagagcgtgaagtataaagaaatgtgtgctctgtgtagtcaggagaagagaggctgcattgtgtgcggaagtagagaagaaaccctgattggacacaaatagtggtgtaaaagtgtgtccagaattggtgggttcttggcctcactgacttcaagaatgaagccgcagaccctcgcggctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggttt

SEQ ID NO: 50695 - DNA, 3605 bp, Homo sapiens
  misc_feature (3294)..(3294): n is a, c, g, or t
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgacttaaaaaaaaaaaaaaanaaaaaaaaaaaaaatttgtggggggcttgggcccggaaaaagtttttaaaaccaattggtgggggggggggggcccagataggttagggtaaccgtgtggccaaagcgtgctcccaaggaaaactcgggcgccaaggagacaaaggggcggggatctccctccccaattataaaaaaaccgcccgggggggaaccccagagcggtttctggacacaattctccgaagagggaggtcccggagggccactacaggggatccttcctcaccagggaggcccagaggaacgctccgaaatccaaagttaggcga

SEQ ID NO: 50696 - DNA, 3195 bp, Homo sapiens
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaacaaatggtgtctcgtagtctgacgatttcagcacggagcatcactctgccttccgggttcaagctattcatcatatgccgtctcaaggagctgagtttacagcttcctacatgataggcagaaatctctaccacatcatttgctttcttaccgggtaatacgaggccccgtccgcaggctcaagccatgtacatcgc

SEQ ID NO: 50697 - DNA, 1148 bp, Homo sapiens
ggaacccgcgcaaattgaaaggtcagcctttcgcgcgctgtgtaggcaagttgcccgtgttctgcgttgccggccgtgggtgctctggccacagcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgatagaagacgacaagccaatcttcttaagggaaagcaacttcttcgtgaggggaaagtctcggaagctcgagagtgtttcacccggtctatcaatatcacacatgccatggcccacaaagtaattaaaggtcaagctagaaggaaacgatgcgatgcaggacagagcgtgaagtataaagaaatgtgtgctctgtgtagtcaggagaagagaggctgcattgtgtgcggaagtagagaagaaaccctgattggacacaaatagtggtgtaaaagtgtgtccagaattggtgggttcttggcctcactgacttcaagaatgaagccgcagaccctcgcggctgcccggtctcagggggtagattgcctcgtggctccctatgaagctgatgcgcagttggcctatcttaacaaagcgggaattgtgcaagccataattacagaggactcggatctcctagcttttggctgtaaaaaggttgtgactacctgtcatcactgcgtgggattggattagcaaaggcatgcaaagtcctaagactagccaataatccagatatagtaaaggtaagagtgatttgctaag

SEQ ID NO: 50698 - DNA, 3278 bp, Homo sapiens
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactt

SEQ ID NO: 50699 - DNA, 3364 bp, Homo sapiens
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggttt

SEQ ID NO: 50700 - DNA, 3268 bp, Homo sapiens
ggaacccgcgcaaattgaaaggtcagcctttcgcgcgctgtgtaggcaagttgcccgtgttctgcgttgccggccgtgggtgctctggccacagcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgatagaagacgacaagccaatcttcttaagggaaagcaacttcttcgtgaggggaaagtctcggaagctcgagagtgtttcacccggtctatcaatatcacacatgccatggcccacaaagtaattaaaggtcaagctagaaggaaacgatgcgatgcaggacagagcgtgaagtataaagaaatgtgtgctctgtgtagtcaggagaagagaggctgcattgtgtgcggaagtagagaagaaaccctgattggacacaaatagtggtgtaaaagtgtgtccagaattggtgggttcttggcctcactgacttcaagaatgaagccgcagaccctcgcggctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggttt

SEQ ID NO: 50701 - DNA, 4179 bp, Homo sapiens
  misc_feature (3294)..(3294): n is a, c, g, or t
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgacttaaaaaaaaaaaaaaanaaaaaaaaaaaacactttttgggccggccttgggcccctgaaaaaaccttctttaacccaattctgttgggccgcggggcccccattgggctaggtgaaccatgtcgccaaacgtggttccctagggaaacctccgggccaaggaaatagcgcgttgggtcttccccctattaaaaaaacccccggggggcaacccgaggcggttctctggcacactttccaagatgggagttctggaggggcccattaacggggctcttttcccccggggggctctcaccgcgagacccccgatttctcaattaccccccgcctttcgtgtgcctcaccaacaccaacgcacaataacacaatacaaaacaaaaaaactcacaaaaaacacccaaactaaaaaataccacgcacacactaaaaaccacaaaaaaaacacacacacacacacaacacactacactaacacaacaaccagccacaacacaaccaacaccactacgccacaccacacagtacaccccaccctcaccacactacctccaccccatactccaaccatccgacctccaccaccctccaccctactacccgccaaacaaccaccaccacctacctataccaccaaccaacccaccccccaccccacaccccaaccccccaccccacccactctcacaacatcaccacaaccatcacaacaccccctctcatccacccacccatccaccactctaaccatcaccaccccacgcccccccccccagccccacccccacacacaccccagcccctcacacccacccacccacccacacccacactccaccaagccccacccacacccacccaccacaccactccacaccacccaaccctcacaacaccctcccc

SEQ ID NO: 50702 - DNA, 3261 bp, Homo sapiens
ggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaatggagtctcgctgtgtcacaatctcagctcactgcaacctctgcctcccaggttcaagcaattctgcctcagcctcccaaggagctgagattacagcttcctccatcctaggcagaaataaagtcccaaatctttgttttttaacgggtcatagaggacccatcatcaccctttattcattccttgatcatctcaggctagagaagtctagggatacagctatatataacatgaccagaagaattaactgggccgtagcata

SEQ ID NO: 50703 - DNA, 884 bp, Homo sapiens
ccaactttcctggctctgatccagggctctttacactatgctgctcccactctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgaagactggtcttttccagcttggtattgagaggttttcagctggactcagtttgctgacagcaaagaaatacagctgctatctagtagtgactagtcgttaggagccgacatgaagaactcgtacacaaggaatagggactgttttggccccttgaatgctccatcgatgtggctcaccgtgagttaggagagctagaccaccagctataggcttctccgccttgtctgcaatttactgtcataatctgttttactaccccgctttatttatgttattgctgctgaaaacctcaaactatagtttgtttcttttacgttatccatagtagtttggtcctttgtgtgtaatgagtacaggtatgtctataaagtgagtggccttttcttttctttttaaattcagaatgtaaacctctaagtcaaagttgttccattatgagtcagccactttagaggttagtcacttgaccaaatgctgctgtcatcgatgacctttgcctttcagattgctgctagaaccaaccacatgtt

SEQ ID NO: 50704 - DNA, 564 bp, Homo sapiens
cttgggtatgtaatcctcctagatgcctgtctatctccatccacacatcacaagtctactcccgtgagcagtgttatgtgtgaacctgtgaacccttgttcatgtcatgtctcttgtgttttcatgagatgcgtttttaattaactgtgacattcagtcccaagaaaggctttgcttacgagtaaaattgcgaagtatgttagccattgggatggttagcttatacaatctctttggagccatgtgaatgaaaagctttagctaaatttaagattactatctttattttctgtattaatgaaagcttattactggctaaaatgggagttaacttttctaaaaattggtgcttagcagtaggataatttttctgtgtaggcaggctatccaaagagctactgataattttttgttcgtttgtttgattagactctgtttacagaccccggccaggtagcttatgtccaacaggatgctacagctcagcaggcctcattgccagttcataaccaggtgctgccttccatcgagagtgtagatgggtccgaccctttggcaactctg

SEQ ID NO: 50705 - DNA, 649 bp, Homo sapiens
ccaactttcctggctctgatccagggctctttacactatgctgctcccactctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggcctcattgccagttcataaccaggtgctgccttccatcgagagtgtagatgggtccgaccctttggcaactctg

SEQ ID NO: 50706 - DNA, 264 bp, Homo sapiens
gcagaattattgagtcatatggcaacactatatttaacattctgagaaactgttaaaacccttttccaaagtggcttcacaattttacattcctagcagcaatgaatgagggtcccaatttttctacattcttgtctactaacttaccattgttaaagtctctctctgttttgtttttttttagccatcctagtggctgcctacataccttttcacagaagaaaataactttattaaatgttaatgattaaagtatgttatggt

SEQ ID NO: 50707 - DNA, 291 bp, Homo sapiens
ccagaccctcagcacccgtaactgatctccgagttcttggtctacttgctggcctggggaagcacctccaccaagtgggcggagggtgagtcggtgaagggcccatgaggtctgacccgcttcctgtccatcatccctacccgatgggggccaggctctaagcccagcccgctatgggggtcaagggggttcctaccaaggcctggaccctttatcctctatccatcgggctgctctctcctcccacaggtgaggggtgagtgtctcttccacccccaccccaaacgccat

SEQ ID NO: 50708 - DNA, 539 bp, Homo sapiens
caaaaggtagtttgttctgccttccaatctctcctcaatcctttcatcacctcttatggaaagttagattttttaagatattttttatttctttaaagatgatttatgtttgtaagaccaggtggtgcactgtgtactaatacatgtccacagaagccaactcttgcagggctggactgttctaaatctagaactgttgtttatttaattccctctagcagtatttctcaaactttttgactatgatccacagtaagaagcagtgcatgcgtgcccacacatattcacattcatacctacacccacaactgaaacaaaaactttgagacagtacttaatcttactgtgaggcaatctgttagaattttcattctgttttatttcatttagaaaaattgggttggtatgggcactttgaaaaaaacactgccctatatagtgcttaacaaaatgtattttcccaggaggtggaggttgtagtaagccgaaatcacatcactctagcccgggtgacagagcgagactctgtctcaaaaaaa

SEQ ID NO: 50709 - DNA, 1222 bp, Homo sapiens
tgttttggtttttcagtttgtacaagaggaagaagacgcatgatatgtgtttggctcatgtgcctgaatatggctccacagggaagacttgatacagctgaagctattgctttttagagactttttattttgagcagctgccttaacagccttcgtcttgttacatcacatgagatatatctctggaataggaagagaaaaaagacatgactgagcaataatttttgactaaaacttaaaattacaaaaccaaaaccagagatagatgtccctgaagttgtatttttatagtatgtgagaacacaattttcttatcctagttttaaggcattcctctggacccaggatttttgtttagtttcattcacataatcaaactcttttttttttttttgccatagactaatgcattttggtgtaatgatctgagcccttatccagaaggcatctaagactcatgtacaaaaatagatttcagggctaaacattctctgttcactaactcttaatgtaatataagggataaattatgcttgtttatttaattgtgcttaaccagagtactaggttggagtcaaaccacagatatatttgtgagatgtgacaaaatgtagcttttagcccgtaatacccaagtcatctgggaacataactgatgacagtgtcaacacctttcaggaattctggaggtgcctttgagtttagaaattcgtaggttctctagaagcaacagtagcatactaaattaacacataacatttcaagctacatttacataattgcagtggttatgattaatacaaattatattaactgcctgttttactccttatagctgattggctgaatttaccagtgggtttggtatgttcaacaaatgatccaaattaccttttcatttcagttaagaaactaatcaaagcaaatacactttgatttgttgagaggcagagattctccctaagtggcaatgtccttggccttctaagctaaaacctaaatggaactataatatatattttgatgctttatctcacttgagttttttattctttaactgaagggcagccatggaccataaatacatagaagataaaaatatattgagcttaggagtttggtctgttcaatggatgagaactttatattttcccttataaacacaattttcaaagaatagcctgtaatagtcgtgaaaatggaaaccaatactggggaaatg

SEQ ID NO: 50710 - DNA, 1278 bp, Homo sapiens
tgttttggtttttcagtttgtacaagaggaagaagacgcatgatatgtgtttggctcatgtgcctgaatatggctccacagggaagacttgatacagctgaagctattgctttttagagactttttattttgagcagctgccttaacagccttcgtcttgttacatcacatgagatatatctctggaataggaagagaaaaaagacatgactgagcaataatttttgactaaaacttaaaattacaaaaccaaaaccagagatagatgtccctgaagttgtatttttatagtatgtgagaacacaattttcttatcctagttttaaggcattcctctggacccaggatttttgtttagtttcattcacataatcaaactcttttttttttttttgccatagactaatgcattttggtgtaatgatctgagcccttatccagaaggcatctaagactcatgtacaaaaatagatttcagggctaaacattctaaaagacaattgagtgcttcttttttctccggcccctagatgtaaatgaataacctctgttcactaactcttaatgtaatataagggataaattatgcttgtttatttaattgtgcttaaccagagtactaggttggagtcaaaccacagatatatttgtgagatgtgacaaaatgtagcttttagcccgtaatacccaagtcatctgggaacataactgatgacagtgtcaacacctttcaggaattctggaggtgcctttgagtttagaaattcgtaggttctctagaagcaacagtagcatactaaattaacacataacatttcaagctacatttacataattgcagtggttatgattaatacaaattatattaactgcctgttttactccttatagctgattggctgaatttaccagtgggtttggtatgttcaacaaatgatccaaattaccttttcatttcagttaagaaactaatcaaagcaaatacactttgatttgttgagaggcagagattctccctaagtggcaatgtccttggccttctaagctaaaacctaaatggaactataatatatattttgatgctttatctcacttgagttttttattctttaactgaagggcagccatggaccataaatacatagaagataaaaatatattgagcttaggagtttggtctgttcaatggatgagaactttatattttcccttataaacacaattttcaaagaatagcctgtaatagtcgtgaaaatggaaaccaatactggggaaatg

SEQ ID NO: 50711 - DNA, 467 bp, Homo sapiens
tttttcttttaaacattttgtaatggaatattctgaacacacagaaaagcagacaattgcacaatgagctccatgttccatcttacatcttcagcagtaatcaacagtcaatctagtatcgtcgtatttcagctctctttgccccctttctccttcgaattaaaaaaaaaattttactgactagagaaagcctatgaattctgaaatatattttgatattattgtgaaaaaattgtacagcttaaaaatagtattatcatttgagatctcatctggttttatcctattttaatatggattagaggatacaaagatggtgatcacccctcccttctttggcgaagtcaagcatcatttcttttctaaattcttacctcatcttcccttatggaaatgccctcctccacccatgcatgcaggtgtgtcggtttttaaatttgtgtcctaataagacttgataaaaacgc

SEQ ID NO: 50712 - DNA, 645 bp, Homo sapiens
aagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatct

SEQ ID NO: 50713 - DNA, 325 bp, Homo sapiens
cccaaagtgctgggattacaggtgtgagccactgagcccggcctaccactctttttaagtggccttctgtaccctgctacatgaattgattgtttctgtggaaaaacataataataaataaacaaataataaagatgtgaacaaactaattttattaataatcccagcgtatatttatctagcatgggaagaaaaagactgggcaatctgtcctttgaaagtaaaaattcaaatattaattttgattattcttttctgaatgccatttcaaaaatgacatatttcttgtatataaatttacttaaatatcactaacattgtaagg

SEQ ID NO: 50714 - DNA, 326 bp, Homo sapiens
ggtccttattctccagcaccttacagataacaaaatggaaaaaaattaaaagctcagaaatagatatatatatccaagaattaatttttatttattgactgattgagacagtctcactctgtcgcctatgctggagtgcagtggcgtgattttggctcacttaacctctgcttctgggttcaagcaattctcgtacctcagtttcctgagtagctgggactacaggcatgcgccaccacggccagctcattttttctattttagtagagacggggtttcactgtgttggccaggctggtctcaaactcctggcctcaaatgatctg

SEQ ID NO: 50715 - DNA, 264 bp, Homo sapiens
gtcttgtcaattaattaccaagttgattctgtgaaataatctggtgatcctggaagggtaaagagaggaatctatactgtcaatatggttctgggcctgaaaaatatcagaacccaggttgtagtatgatttagtcccctgaaatactatgggatatatactactataaatggcttcacttctcctttcagagcagggacacctaaagagcaaatgtctgtttaattaattattccagaagatcctcaatggtgcccttaggag

SEQ ID NO: 50716 - DNA, 356 bp, Homo sapiens
ttgaagaaccagttggtggagctacccccttatacccagctggctgtctctttgagtcatcattggaagactgacatcccgtgtcccttgggactggatggtttgtgctcttctagttttacaaatgcccccaccacattcttgggtgtatctgaggcccagtgtgggctgcagttctccagacttgcaggaaccagtttgatttcccagggctgttgactttttcttgtacttgtatcattgcccctgactttgaggcttaggggaccatggagcactggggaaatcatatgccctcagtcctcactaggggctgggccatccattaaacaaaggctgtccagatgtgttaatga

SEQ ID NO: 50717 - DNA, 1026 bp, Homo sapiens
agaaggtggtattctgactgtatctaacaatagggaagcctgggaaatatggctggctggtgcccaggaaaaggaggaaataagtttggttaaatagttagcaatctttgttgtagaagttgatgaaataaaggtgccccatagcaggtgttcagtagataattttcaatgagttgacttacttacactgcaatttctagcattagtgacttgaaccccaaaaaacagagttggtgagggaggaaaatgttgtaatgatgagtctggtcataaacacagtgagaaagttgtaggtagagatatctggttggcagcttggaattgggtatccctgatagtgtgccccaaaatgatggtctaatattataaattgcaagactccaaatatgttcatgctgttaccacagaaaaagcatgttttgtatccctgcacagattttgttttcctaccattgattgtgatgggtcagatttgttctttattcctttttcatggtggggcttaaaggtctaggacagagtggtggtggtgagtatcacagtgtctgtgcccttttgaggtgatgacacacagagtttctaaatatgacaatggaagattctattcttttcatagtaaaaccctggaggcaggctgtacagagacatgagtcagctctccatctccagcggaactccaggggcttctccaggccaggcttcctgaaggttggccagaaataagacatctgcagcttccaggacagctcagttgctaaataggacttacgttttgtttagtatgtctgggtagtaagaccttgcactgccatatggaggttgtggtaagacaaatttgggcgcagtatgaaggaaagaattttctaaggaagatttctgaacttttaatgggctgcctcatcagaccatcaggaaggccaggcacccagtgagctggaaagatgcagactgtattcctgtactgagcagaggattagactacgttattctcaaaagcccttccatcttgaaaatctcacactcctt

SEQ ID NO: 50718 - DNA, 296 bp, Homo sapiens
acagtgtagccctcctattagaataaataaattatgtggttggactggaatgctacaggcacactatgactggaagtggaaggagagagaatgtttatttaaaatacagcacacataaataataaataaaagtttaaaacttaatcagcaacagcaacaggaccagcctcccctgttccatttatggttcttttcaggaacacctgtatcttttcctaaggataaaaagtggcacaaggagacaaaaggctttggaaggaaagaaaatactttgttgtgactttgtgcttttctga

SEQ ID NO: 50719 - DNA, 290 bp, Homo sapiens
gggagggcaaagctaggcagggctgggctggagaatcctgcattctggccaccccaacagggcacaagcaccagcccttgcaggggttgcaaggcagttctcaggccccgaaggaatgctccagggaggagcagagcaaccactgccatgccaaagatccagcatggggaaagtggggtcgctagggctccacaacctggcaggtgatagtgggacccggttctctacagttttgacctggttggattccctcctaccatctgctgctggcagcaagctgaaacagccag

SEQ ID NO: 50720 - DNA, 415 bp, Homo sapiens
ccatatatttagtctaaaagaaatatcatagggccaggcgcgatggctcacacctataatcccagtacattttgggaggcagaagagagaggattacttgaggccaggagttcgagaccagcctgagcaatagggcaagacctcctgtctgcaacaattttttttttaattgctcgatatggtggcatgcactggtggtcctagctactcaggaggctgaagcaggaggatcccttgagcccaggagtttgaggcttcagtgagctgtgatagttcaactgcactccagcctggatgaccctgtcccccaaaaaagaggaaaataagaaattttatggttaacaaaagcaccaaacctatagtgatttttttcagtcagacagtagtggccatccttctcatcttcacctgtgat

SEQ ID NO: 50721 - DNA, 393 bp, Homo sapiens
aagctgccagtgctatcgtgggggttctgccttgatgactttatctaatgctgactacttcccaaaggtgccaccttcaatcaagaatttggggattaagtctccaaagcatgatatttagaaaacatattcaaaccagagcattatgtatagacagaaatatacacatatttagtacattttaaaagaaagtaaggctcactacatcaatcatacaatcatttagttcctacgtcacatttgctcattagactttgtctataaccaagagtagtgagaagtaaattaagttgctgagatgtctttttggttctaaacacattcaagataaaatgattttaaataagtagaattgcttggcagcttgccacttctgtaacaattctgcttatt

SEQ ID NO: 50722 - DNA, 671 bp, Homo sapiens
acgagactctggcatgctaactagttacgcgacccccgagcagggatccaggatgaacccccaaaagttcggggtgagaacttctcttggtggaaggtgatggaggaagacctgcaaagccagctcctccagcggcttcagggatcctctgttgtcccagtgaacagatagagaggtggaggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctctccccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcacctaatttaactatataatcacttgagggtggccggtacccatttgcccttaaggaggcgtttccatttggccgcgtt

SEQ ID NO: 50723 - DNA, 1533 bp, Homo sapiens
ggagctcccggcccgctgccgcagggactgggagcggtctccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctgtggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtggaggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctctccccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcacc

SEQ ID NO: 50724 - DNA, 1770 bp, Homo sapiens
ggagctcccggcccgctgccgcagggactgggagcggtctccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtatggcccacctggaggcagtgtgaacagggccagttgacacctttcccccagctcctcggtgaggtgagcccctctacagccagtcctgttatggctggcacagcctggcatgggcagattccagcctttgggctgggggcctctctcctgggtcagggatgtctgttgactctgccagagctgcacttctctccacacagaccctccctgccccatcccccacatctcccccaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctgtggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtggaggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctctccccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcacc

SEQ ID NO: 50725 - DNA, 1934 bp, Homo sapiens
ggagctcccggcccgctgccgcagggactgggagcggtctccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctgtggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtggaggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctctccccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcaccttgcctccctgcctacacgtctctgtggggagaaagtgatggggactactgtccaggagctgctgctcccctcgtgttacccacaggcacccatgcctttcccagtgcactgacagtgcgggccagtctgctgtccagcacggcccctggggctccctccagttggcctgctggcccgggatgtgactctgaggggacccatccctaatgaaacacagctctgagccctccaagggttgggcagtgggcggccccagaggaacttcaagtgggacaggagctgcaggtgctgcctctgctctctccttgagcctccctggcgcagaccactccccctggctctcctgcctctgccttttcacaacttcagcccatgccagaccaaaccttttcttcatttc

SEQ ID NO: 50726 - DNA, 326 bp, Homo sapiens
ggtcatgcctgcatcttaggactgttaggactgttgtaaggaacagatgcctttaaaagctcagcatagtatctgacatatccaagtttttttacatgcagagaattacttttattctatagggaacatgctactgttatcaagcaaaagtggctcactgcctgatgtgctagaggccaatactgtgacactggagatttgtcgggggaaaaaagccctatattgcaggtcaactcacaaggagacaggagtcaagctcaaatctgtctccccatgctggcttcaaggcagcattattattagaaaaggttcagggagtagatctt

SEQ ID NO: 50727 - DNA, 375 bp, Homo sapiens
tagggctgcatcctgaggagagaccaaggaggagaggaggcacccaagcaaaatgtcccttccctgtggatcaagtgcagatacgctgtcttcctctgtgtgtgtatttgtttgatgagtagatggttcagagcagtggatctgggtcagattgacctgggttcaaatccaagctcaggctcttacttcctggcacatgactcaacctttctgacagtcaatttcttcagctgtaaactaggagtgatgtgccaggtgcggtgactcacacctgtaatcccagcaactcaggaagccaaggtgggaggattgctcgaggccaggagttcaaggccagcctgggcaacatagcaagaccccatctcaaaacaaaag

SEQ ID NO: 50728 - DNA, 416 bp, Homo sapiens
tccgagatggactatcactctgtcacccaggccggagtgcaatgatgcaactccaacctccacctcccatgagattctcctgcctcagactccgagtagctgagattatagtcacccggctaatttttgtatttttagtagagagaaggtttcaccatgttggccaggctggtcttgacctcagttgatctgcccacctcagactcccaaagtgctggtattacaggtatgagccacggcacctgaccataaagcatattcttaacaagtgtttgatacacacttttactcaccttaacagtactgcagtgcaaacctttggccataagaatataaaccaaatctcttgttaaattgtctttaattcccaggataacaccactatagacagaaggtacttcccactaaaagaaaca

SEQ ID NO: 50729 - DNA, 251 bp, Homo sapiens
atattgttatcaacaatacacaaactcaatataatcatcagaaaatatcatgtaaatccaacttaagataaacccagattaagagttcatccttggaataactgaccaccttttttcaaaagtacatagatcatgaaggacaaggaaggactgaggaattgtgtcaagttggagggagactgcagaggcacaagaacagaagcaatatatgatcctgaattcattcctggaatagaaaagagatgtttgag

SEQ ID NO: 50730 - DNA, 324 bp, Homo sapiens
gcaagaaaacaaagtggaaaacaataaggaagtgaaggtaacccctttataacctcccactgcttcattccttggaaatagaaatgactcagggaggcagatgaggataaataaaacgctgccttgaaacagtctctatgcttagctagattctgtctgcagctgctttctgcagaatcctgcaaattgggtttgtcatctgaccgtgtctctctcctcctgtgtctctacatctatttcaggtccctgggtttgctcgtgtctgttgccttggttcctctgctgtgttcctctaactgtgggcaatgcctccatccatttcta

SEQ ID NO: 50731 - DNA, 699 bp, Homo sapiens
gtgttaatataaaaaacatttgtcaagagtagaccctttctgagaaatatattagacaatatttgtttcagttatcttagtaggatttttccccttttaggttttgtttgtttccttttggctttgttttgtttggtcttgtttcttttaaattaaactaattttggaatgtgctgacacgcgagagtggtactggatagccagtggaaatgcgtggcatacgttcctagaacattaattttacctgaggtctgggagagagactttttttatgagataaacatgggtgtcctagagtatcattgcaaattagtgtgaatttttatgattaaaaatgagaagagaaatttggtattttttggaggactattttaggctgtgccccaaaaccctgggaatatttgttcactctctctgccattatggctgcttctgtgtagggaaaataaaatgacaaacctacatgttttctcacagatgataaatgtatttcttcttctctgtagcctattaattaatatctaacactgctgtctcttctagcttccacagtttactttcttttggtgcataatttaatgagtgttcgtttattttctgaagtgttatttgtataaagtgagcccacataaaagcttctttccaaagtgttttcatgggaaacggatcttggtggtgatctgtcacttagcacgtcac

SEQ ID NO: 50732 - DNA, 290 bp, Homo sapiens
aaaaaacttaaaaatcagctggacgtgctgatgtgtgcctgtagtcccagctactagggaggctgaggtgttaagggattgcttgagcttgtccaggaggtcgaggctacagtgagccataatcgtgccaccacattccatcctgggtgacaaagcgagaacctgtcttaaaaaacaaataagagacaaacaagagaatacataacataagctaagtaaattttctgtagaggtcgtacccatataaatattcaggaggtgaccatactttccctgtttgtaaacccctt

SEQ ID NO: 50733 - DNA, 1315 bp, Homo sapiens
tcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcataaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgatgaagaaattgatacaacaatgagatggaaactcctccctcattcagatgaaccttaaaacctcaaacctagtaattttttgttgatctcctataaacttatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaacttaga

SEQ ID NO: 50734 - DNA, 1296 bp, Homo sapiens
tcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcataaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgaatgagatggaaactcctccctcattcagatgaaccttaaaacctcaaacctagtaattttttgttgatctcctataaacttatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaacttaga

SEQ ID NO: 50735 - DNA, 979 bp, Homo sapiens
tcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcataaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagggactatgtgaagaagctgttggctggtcgcatggggaaataaataagggatggcatatgccatatttatggatttctttctttcttgccca

SEQ ID NO: 50736 - DNA, 647 bp, Homo sapiens
ctattactcttgtgtctagatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaaccctagcttgttccgctgggggatctctagagtcaact

SEQ ID NO: 50737 - DNA, 5359 bp, Homo sapiens
ggggccgcgtcgacgcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgctagtcccctccctcctgggggagcagctgccgccgctgccgccgccgccaccaccatcagcgcgcggggcccggccagagcgagccgggcgagcggcgcgctagggggagggcgggggcggggaggggggtgggcgaagggggcgggagggcgtggggggagggtctcgctctcccgactaccagagcccgagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatggatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttcaaaaaaaaaaaaaaaaaaaaaaaaaaaaaaaaaaaaaaaaaaaaaaagaaaaaaaaaaaaaaaaaaagaagagaagaaggcgacacaagacaagaaataatcatccaagaagaagagcagaagatcacgaacagaggacgcgacgacccgatacgaagggacacacatgaaacacacacgaatcccagacgcttgactactgccccgaccagagagcagataccaaccctgcagacatgtgctagaagaaagaagacaaaaccgccgagggctcaattttaaatgagaggaaacaacaccaaacatcgtgcaaacacgaaacaagaagtaagagaaagaaataatgacagaggtacccatacacgcgcatcaaaaaatcaacatgggcccgggcaagaggaaaaaaagtggaagacatacacccagacgacgataataataggtgagatcgaacaacacaaacacacacctctataatcagaatcagtatgaaacatcatatagcgaaataccaaaagaccaaaca

SEQ ID NO: 50738 - DNA, 3816 bp, Homo sapiens
ggggccgcgtcgacgcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgctagtcccctccctcctgggggagcagctgccgccgctgccgccgccgccaccaccatcagcgcgcggggcccggccagagcgagccgggcgagcggcgcgctagggggagggcgggggcggggaggggggtgggcgaagggggcgggagggcgtggggggagggtctcgctctcccgactaccagagcccgagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatggatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttgtcctaccctattatatttttctctaccatgtgttatctttttgcttgctttgggctagttcaagtattccgccaggttttgaactgtgtggtcgtttggaaagtgctcttttaagggcgccaaggttcttgaaaaaaaaatcgggccgaatgggagaagaaagatcaaccaggtcata

SEQ ID NO: 50739 - DNA, 2941 bp, Homo sapiens
ctgtataattctgactgaatagctaacagtagtcagttcatcatacttattgttgctaatctacttagcttccttgtgctgaataggggattgaaccagatgactaataatggtccctttaatgctaaaatggctgtgattttacatttttaaaaaacccacaaaagaatgaacttaagatttaagaactgttttccttggtcataagaatttctcttaaataaaagcattgggatgataaaaatgtaatcaaaccaacaacatagattcctttcccagtcccagttttgtcagctggtgtttaaagggagtcaaagattgctaatatttttttttcctgtgcagatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttcaaaaaaaaaaaaaaaaaaaaaaaaaaaaaaaaaaaaaaaaaaaaaaagaaaaaaaaaaaaaaaaaaagaagagaagaaggcgacacaagacaagaaataatcatccaagaagaagagcagaagatcacgaacagaggacgcgacgacccgatacgaagggacacacatgaaacacacacgaatcccagacgcttgactactgccccgaccagagagcagataccaaccctgcagacatgtgctagaagaaagaagacaaaaccgccgagggctcaattttaaatgagaggaaacaacaccaaacatcgtgcaaacacgaaacaagaagtaagagaaagaaataatgacagaggtacccatacacgcgcatcaaaaaatcaacatgggcccgggcaagaggaaaaaaagtggaagacatacacccagacgacgataataataggtgagatcgaacaacacaaacacacacctctataatcagaatcagtatgaaacatcatatagcgaaataccaaaagaccaaaca

SEQ ID NO: 50740 - DNA, 1445 bp, Homo sapiens
tccttgaatgaatgaatgaggcaggacagggttgttaaaagagcttccctttggagtccgacccttgcttcgaaacttctagtagtgcagcttgcatgataggagggggccccccctcctatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttcaaaaaaaaaaaaaaaaaaaaaaaaaaaaaaaaaaaaaaaaaaaaaaagaaaaaaaaaaaaaaaaaaagaagagaagaaggcgacacaagacaagaaataatcatccaagaagaagagcagaagatcacgaacagaggacgcgacgacccgatacgaagggacacacatgaaacacacacgaatcccagacgcttgactactgccccgaccagagagcagataccaaccctgcagacatgtgctagaagaaagaagacaaaaccgccgagggctcaattttaaatgagaggaaacaacaccaaacatcgtgcaaacacgaaacaagaagtaagagaaagaaataatgacagaggtacccatacacgcgcatcaaaaaatcaacatgggcccgggcaagaggaaaaaaagtggaagacatacacccagacgacgataataataggtgagatcgaacaacacaaacacacacctctataatcagaatcagtatgaaacatcatatagcgaaataccaaaagaccaaaca

SEQ ID NO: 50741 - DNA, 3169 bp, Homo sapiens
ggggccgcgtcgacgcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgcgggagggtctcgctctcccgactaccagagcccgagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatgggtaataccattaacattttctaagtatagatttaaaactctggatggcggtgtgggggacaaatggttgctgaggttgatttgtactcctctgcttagggtaggaagtgtatgacgggtggtgggattccatgcaccgtggcgggtcagtgatggcagagaagtgggtggctgtgttcattagagacattctgcagctgtcgtttagagcccacatgagcttaacgacactagacgcagaaaatccacggtaactgcagacagcactagatttgaaagctggcactttagatataactttgcttatattctaactctttggtgcaaatagaaaaacatcagcttatcctcttgatatgctttgcgtctgtcgtaaataggtattcctttgaataattattcaggataataatgaaagaagttagattaaactacttgactgctgtactttcagagggagaaattctacttaccacaattcttgattttccatgcccttgatgggtactgttaatgtcactgtatatactctttattttacgctttgtctcatatccaaaatca

SEQ ID NO: 50742 - DNA, 2788 bp, Homo sapiens
ggggccgcgtcgacgcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgcgggagggtctcgctctcccgactaccagagcccgagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatggatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggatta

SEQ ID NO: 50743 - DNA, 516 bp, Homo sapiens
cagaaattcataatctacattcattctgaaaacttttatattaatattcagcaagtgatctttaagattgagctaggaacttgtggccctggtgtgttattttcaaataactagaaacttacattttcaaatgatgatttttatctttgaagcaaggattttgattttgttttggttttatagcttattttcaaagttaagaaacgcaagaaagggtgttaatatatttcattcaggaaaggtcctggttggtaaaatatgtaaaagtacaaacttctgaattcaccatcatttcctgatggatttgtaaaaatttttctccccagtctaatgtatttgtttgtatactaacttccacacagggctatggaacacacctgatgaatcatttgaaagaatatcacataaagcatgacatcctgaacttcctcacatatgcagatgaatatgcaattggatactttaagaaacaggttggtttctcaccacgcaacactgttttgtcactccttttct

SEQ ID NO: 50744 - DNA, 4296 bp, Homo sapiens
ggggccgcgtcgacgcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgctagtcccctccctcctgggggagcagctgccgccgctgccgccgccgccaccaccatcagcgcgcggggcccggccagagcgagccgggcgagcggcgcgctagggggagggcgggggcggggaggggggtgggcgaagggggcgggagggcgtggggggagggtctcgctctcccgactaccagagcccgagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatggatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttaaaagggggaacaggcctgtatcccccctaacatctatggtatctctttatagtatgttctgacctc

SEQ ID NO: 50745 - DNA, 3679 bp, Homo sapiens
tctgtcttgtcttcataacttgtatgtgtatgtgtctctgtgtgtatgtgtgcacacatgtgtatttaggactctgaaaatccacaaatgtgtatcttattagaacaaagatgagaagcttggatgtgtcccatccccactgtcttgagagaatagctctgtgtaattttttcctgtctcttgcatctcagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatggatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttcaaaaaaaaaaaaaaaaaaaaaaaaaaaaaaaaaaaaaaaaaaaaaaagaaaaaaaaaaaaaaaaaaagaagagaagaaggcgacacaagacaagaaataatcatccaagaagaagagcagaagatcacgaacagaggacgcgacgacccgatacgaagggacacacatgaaacacacacgaatcccagacgcttgactactgccccgaccagagagcagataccaaccctgcagacatgtgctagaagaaagaagacaaaaccgccgagggctcaattttaaatgagaggaaacaacaccaaacatcgtgcaaacacgaaacaagaagtaagagaaagaaataatgacagaggtacccatacacgcgcatcaaaaaatcaacatgggcccgggcaagaggaaaaaaagtggaagacatacacccagacgacgataataataggtgagatcgaacaacacaaacacacacctctataatcagaatcagtatgaaacatcatatagcgaaataccaaaagaccaaaca

SEQ ID NO: 50746 - DNA, 2087 bp, Homo sapiens
ggggccgcgtcgacgcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgcgggagggtctcgctctcccgactaccagagcccgagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagaggtcagcagggtaaacctgggcagccagctggtagacctcttctgctctcctggccactccagctgtcagaagtggggatgctaatgctgagagttaacatgttatgctaccctggtttgcatttaacctggtggtcagtgtggagagggcaggaacaactgatcaagaggtaattccccttgatgaatatcacatcacaggtccacttactaataatctcacagttgaaggcatcattcccagctttttatcttgaaaaatttcaagccctcataaatgttgcagaaattctgtaataaaaatccatagactctttacttagattcagcagttaacattatgccacatttgctatctctctttctctctgcgc

SEQ ID NO: 50747 - DNA, 455 bp, Homo sapiens
tcatgggccgtctcatcaacatggcttccagtgaccaccctttttattctcttaggaagccaaagaacaacgctgcatctgacactcacttcaatagcacctgaattatgtgcttctccttaaaatgtggcccagtgacattttgggctggatgataaaaaataaaaataaattaaaaatgtggcccgagtatttaagagcaaaatattgacactgatttatcagggtggttctctcacatccactattatctaattcaaagcaaacagatatccttatctggcatgacagtcttaaggcctgtgtgtctggtatcaagccctcaaaaatgtctttttatgtctgatgatttactgaaaaccctaataccctttctgttttcttgttgcttgagcccttaatgcgtgccaggcactgtgccaaatgctttacagacgttatctcattccatcctc

SEQ ID NO: 50748 - DNA, 419 bp, Homo sapiens
atatatatatatgcacacacacacacacacatacacacacagacacacacgtatgaagagtgaggaaaaaaatcatggtacatgtgtcatgaccaagtagggtttctacaaagtgcttacatttgaaaatcagtgtgacagaatacaaggtaaaatctgctcaccttaagagatctggagaaggcatttgaaagaattcaactccttttgtgataaaccaaattgttagccaactgggaatagaagggaacattttcaacctgataaaggtatgaaactacagcttagcattattatattcaatagtgtaagataatgcttttcccctaatatcaagaacgaggcaaggatgcctagtcttattgattctattcaacattttgcagacagaaaatcctggctagttcagtaaagctgta

SEQ ID NO: 50749 - DNA, 575 bp, Homo sapiens
tcagaactctcatggagagctgaaatgtttatgactatcaaacagaacaggagttaactgaattaactgaaccaatagaaaactaatctttttgacctttttgcttaaaacattgctaatactttgttttgttttttagaattatgaaaactaaagctatttacagcttttaacaattgagtaaagtatactgttaccagaattgggagcatatttgtttctctctacctggtttctccagaatttggaaactatttagtcactgaaaactaagctgtgttttcttaaaaccctgcaaactgaagccagacaacttgaacttcagaagaaaataacagcaacctatttacgtacataagccactttcatacctgcctactaatgtatggacttcagagtaatgtggcttatatcgatttttctaggattgttcttttgtttgttgttgttttttctcccttcctccctgctattttctcttcacagaatgtgagacttcacaacctactaaaaatgagcttttgggacttacccatctaggaataaaccatcatagctatgagaaatcagatgaa

SEQ ID NO: 50750 - DNA, 1711 bp, Homo sapiens
gggaagggaagtgcgtcggtaggggagggctcacctctccaggttgaaacgatggcggtcagaaccgcctgaggtaaaaacgggtggcactggggaagcggaggcgtagctcccgagagcctcacacttgtgctcagtgccgcctcacccctggtggatccgcgatggccgcggattcccctggattgccggcgctgggcaggagcgccacttctaatctctcccgagactggacgcccggcgccttccacgcgcgttgtgtctttccgggcggtccctcgaagctggctaccccgcgggctgttgactgcagtgggatctggtcactcagatgcggatagagggctaaatgcaagatggtatggcatccagactctgctcataagtatctgcagtgatccataccttgattgtacatctactctgcatcctgaggacctgaacatgctaactggtggctgcagatttgtcttctaaggagcaagtgtggtctgtggacaggcagcttcagcctcacctgggattttgtttgcactagaaagtgccaagccctaccctagacctattaaagcagaactggcgtttaacaagacaccccaggtaatttgtgtgcaccttagagtctgagatgcactagtgtagtgattcgcagggggacaattttgacctccaggggacaatatctggagacatttttgggtgtcacaacgtgctggggagagggtgctactggcatctaatgggctgaggccaagggtgctgctaaacatccggcaataccgggccaacctcccccctcctcctgcccacagtaaagaattaccccgcctggattgtcagtagtgcagaggtagaggaaaccctacacctgtgaaactcatctgacctttactatgaattcctggatctcctggtgcatatcatttctgttgccctggctgacatttccaccttttctcttttctagattttattacaagaactcaatctgttggtctctaggaatcacctattgccttgctatgttttgttgaacctgtttttgaatctgctttctacattgggggaaatagggtatacgtttgttaaaccttaaaagctctgtatgcttataagggaaatcaccagacacgtgggataaagctttgcagaggtgaagggctgtcttccaccagagagaacccagaaggagttcagggttaagcctgactcatcatgagatcaggtatccccaatccacagcggacttccacagttcaccttcctaggtaaccgctctgccttcccaggtaaagtaggaataatatcagaacttacagcatattttgaggtcaaattgtagaatttggtgatttcatttttattattactcaaccttttatttacaaccaaattaataaggctacttacacataacaatgtgtggacatacacattaagagaatcatttgctgcctagcactcctacctaggtactttaagaacatcattgagtggatactccctctgctgggtaaaatactttgccacaatatcagctgaaatgatacctcttccagactgtaatggcagaagtagttatcccctctttcgtgctgtcatcacacttgatgcatgcctactttataatacttatgccattgtctctgttattgggtttctgtcttctactgtgaaagggtgagcccataaaaaacagggaatgtgtctt

SEQ ID NO: 50751 - DNA, 1439 bp, Homo sapiens
gggaagggaagtgcgtcggtaggggagggctcacctctccaggttgaaacgatggcggtcagaaccgcctgagctaaatgcaagatggtatggcatccagactctgctcataagtatctgcagtgatccataccttgattgtacatctactctgcatcctgaggacctgaacatgctaactggtggctgcagatttgtcttctaaggagcaagtgtggtctgtggacaggcagcttcagcctcacctgggattttgtttgcactagaaagtgccaagccctaccctagacctattaaagcagaactggcgtttaacaagacaccccaggtaatttgtgtgcaccttagagtctgagatgcactagtgtagtgattcgcagggggacaattttgacctccaggggacaatatctggagacatttttgggtgtcacaacgtgctggggagagggtgctactggcatctaatgggctgaggccaagggtgctgctaaacatccggcaataccgggccaacctcccccctcctcctgcccacagtaaagaattaccccgcctggattgtcagtagtgcagaggtagaggaaaccctacacctgtgaaactcatctgacctttactatgaattcctggatctcctggtgcatatcatttctgttgccctggctgacatttccaccttttctcttttctagattttattacaagaactcaatctgttggtctctaggaatcacctattgccttgctatgttttgttgaacctgtttttgaatctgctttctacattgggggaaatagggtatacgtttgttaaaccttaaaagctctgtatgcttataagggaaatcaccagacacgtgggataaagctttgcagaggtgaagggctgtcttccaccagagagaacccagaaggagttcagggttaagcctgactcatcatgagatcaggtatccccaatccacagcggacttccacagttcaccttcctaggtaaccgctctgccttcccaggtaaagtaggaataatatcagaacttacagcatattttgaggtcaaattgtagaatttggtgatttcatttttattattactcaaccttttatttacaaccaaattaataaggctacttacacataacaatgtgtggacatacacattaagagaatcatttgctgcctagcactcctacctaggtactttaagaacatcattgagtggatactccctctgctgggtaaaatactttgccacaatatcagctgaaatgatacctcttccagactgtaatggcagaagtagttatcccctctttcgtgctgtcatcacacttgatgcatgcctactttataatacttatgccattgtctctgttattgggtttctgtcttctactgtgaaagggtgagcccataaaaaacagggaatgtgtctt

SEQ ID NO: 50752 - DNA, 1785 bp, Homo sapiens
gggaagggaagtgcgtcggtaggggagggctcacctctccaggttgaaacgatggcggtcagaaccgcctgaggtaaaaacgggtggcactggggaagcggaggcgtagctcccgagagcctcacacttgtgctcagtgccgcctcacccctggtggatccgcgatggccgcggattcccctggattgccggcgctgggcaggagcgccacttctaatctctcccgagactggacgcccggcgccttccacgcgcgttgtgtctttccgggcggtccctcgaagctggctaccccgcgggctgttgactgcagtgggatctggtcactcagatgcggatagagggctaaatgcaagatggtatggcatccagactctgctcataagtatctgcagtgatccataccttgattgtacatctactctgcatcctgaggacctgaacatgctaactggtggctgcagatttgtcttctaaggagcaagtgtggtctgtggacaggcagcttcagcctcacctgggattttgtttgcactagaaagtgccaagccctaccctagacctattaaagcagaactggcgtttaacaagacaccccaggtaatttgtgtgcaccttagagtctgagatgcactagtgtagtgattcgcagggggacaattttgacctccaggggacaatatctggagacatttttgggtgtcacaacgtgctggggagagggtgctactggcatctaatgggctgaggccaagggtgctgctaaacatccggcaataccgggccaacctcccccctcctcctgcccacagtaaagaattaccccgcctggattgtcagtagtgcagaggtagaggaaaccctacacctgtgaaactcatctgacctttactatgaattcctggatctcctggtgcatatcatttctgttgccctggctgacatttccaccttttctcttttctagattttattacaagaactcaatctgttggtctctaggaatcacctattgccttgctatgttttgttgaacctgtttttgaatctgctttctacattgggggaaatagggtatacgtttgttaaaccttaaaagctctgtatgcttataagggaaatcaccagacacgtgggataaagctttgcagaggtgaagggctgtcttccaccagagagaacccagaaggagttcagggttaagcctgactcatcatgagatcaggtatccccaatccacagcggacttccacagttcaccttcctaggtaaccgctctgccttcccaggtaaagtaggaataatatcagaacttacagcatattttgaggtcaaattgtagaatttggtgatttcatttttattattactcaaccttttatttacaaccaaattaataaggctacttacacataacaatgtgtggacatacacattaagagaatcatttgctgcctagcactcctacctaggtactttaagaacatcattgagtggatactccctctgctgggtaaaatactttgccacaatatcagctgaaatgatacctcttccagactgtaatggcagaagtagttatcccctctttcgtgctgtcatcacacttgatgcatgcctactttataatacttatgccattgtctctgttattgggtttctgtcttctactgtgaaagggtgagcccataaaaaacagggaatgtgtctttcaaaatgttgtatcctgctcattctgatgtgaagccattgtcctccttcaataaaataaaacagcatttctga

SEQ ID NO: 50753 - DNA, 918 bp, Homo sapiens
gggaagggaagtgcgtcggtaggggagggctcacctctccaggttgaaacgatggcggtcagaaccgcctgaggtaaaaacgggtggcactggggaagcggaggcgtagctcccgagagcctcacacttgtgctcagtgccgcctcacccctggtggatccgcgatggccgcggattcccctggattgccggcgctgggcaggagcgccacttctaatctctcccgagactggacgcccggcgccttccacgcgcgttgtgtctttccgggcggtccctcgaagctggctaccccgcgggctgttgactgcagtgggatctggtcactcagatgcggatagagggctaaatgcaagatggtatggcatccagactctgctcataagtatctgcagtgatccataccttgattgtacatctactctgcatcctgaggacctgaacatgctaactggtggctgcagatttgtcttctaaggagcaagtgtggtctgtggacaggcagcttcagcctcacctgggattttgtttgcactagaaagtgccaagccctaccctagacctattaaagcagaactggcgtttaacaagacaccccagagtcactgaaaactaagctgtgttttcttaaaaccctgcaaactgaagccagacaacttgaacttcagaagaaaataacagcaacctatttacgtacataagccactttcatacctgcctactaatgtatggacttcagagtaatgtggcttatatcgatttttctaggattgttcttttgtttgttgttgttttttctcccttcctccctgctattttctcttcacagaatgtgagacttcacaacctactaaaaatgagcttttgggacttacccatctaggaataaaccatcatagctatgagaaatcagatgaa

SEQ ID NO: 50754 - DNA, 683 bp, Homo sapiens
gggaagggaagtgcgtcggtaggggagggctcacctctccaggttgaaacgatggcggtcagaaccgcctgaggtaaaaacgggtggcactggggaagcggaggcgtagctcccgagagcctcacacttgtgctcagtgccgcctcacccctggtggatccgcgatggccgcggattcccctggattgccggcgctgggcaggagcgccacttctaatctctcccgagactggacgcccggcgccttccacgcgcgttgtgtctttccgggcggtccctcgaagctggctaccccgcgggctgttgactgcagtgggatctggtcactcagatgcggatagaggggtacgggagccggagaggtggaacaggtccttccgggtgcggagagctgggccgtccagccgcctctttgttcccgcgtgggtcccgcgcggaatccccaccaccggggccgactgtcgtggtccctggagtcagcaccctgccctccccgccgtggtggcgggtggctggggggtccccggcccggcgagcccggcggagcgaccctgcgcttctgccctggcgagcttccggactcaggccatttaaatttttttccccagcagaatgaagttactctttgccaaagtcacggtttttaaatgtgtgagcctgaaaacatatcatgcagtcgtttt

SEQ ID NO: 50755 - DNA, 1215 bp, Homo sapiens
catgggcgctgcagcagctacaaagacgacgccggctgcgctcgcgggaccagagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagttttagcactttgtgatcatatttataaaccttggacagggctccttggccttagagttaagtgaagagttaacactgtgactttagatgcatttttctcagtgcaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtg

SEQ ID NO: 50756 - DNA, 1289 bp, Homo sapiens
catgggcgctgcagcagctacaaagacgacgccggctgcgctcgcgggaccagagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagttttagcactttgtgatcatatttataaaccttggacagggctccttggccttagagttaagtgaagagttaacactgtgactttagatgcatttttctcagtgcaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtg

SEQ ID NO: 50757 - DNA, 386 bp, Homo sapiens
gctacttgggaggctgagatgggaagatcacttgagcccgggagattgaggctgcagtgagccaagattgtgccattgcactccagcctgggtgacagagtaagagtgagatcctgtctcaaaacaaaaacaaaacaacttttatagcagatagcatgcaatggttagcatagtaatacaacactgacaattttaactcctatctttgttaagattttatatacttgaaacaggttaatgggaagtattttcctagaaagtaagtttatgcccctttctaataattacataataatgtaacttactgaaatggacaccgctgttaagcactctatgaggccttttataggcattataacaaatcttcatgccagtcctatgtgata

SEQ ID NO: 50758 - DNA, 479 bp, Homo sapiens
aaaatcaagggaaggagttttaatgacttcaggagtagctgagcccttggtttcattttcctgataacgagcactttacagtcctccctggacgctggagatgtgacttagggcacatatctgggctctgaatcattctgaactctgtgtgcccactgaatcagtgtctgtgccaacccatgaataagcagtggcagaaattcctggagggtcttctatccaaattctgatgggtccccatttttctttttagactgaggagataagaacatagggtgggatggccactgataaggcagaagtctgaagtaaggatgtaacacccaaaatgtgaaacagtattcggagtaaaaatatacattattactcaaggaggttcatatccttatcaatgcagcatcccacatgcttccagaaatcgctaatcatgtttatgtcaatgaaaatatcatgtatcagagttgtggattcaaagattt

SEQ ID NO: 50759 - DNA, 315 bp, Homo sapiens
ctaggaatctttctccttcacagtcagaaatcagataaaagataagggaagatgttggtgctaaatttctggacatgctatgcaggagtgaaatgtcagatgacaaagcaatatcaggaagaagactgccaaaggacaatcttgttgaattctgggcagaaacactaaggagagatctgaattgaaactatgttattataataattgtgttatcttcaatctgggcatggcacacacaggaacattctggcctgatgctgctcaagctctccctctttggataaataaatggcttcagttttcaaaacattctcc

SEQ ID NO: 50760 - DNA, 841 bp, Homo sapiens
ctaggaatctttctccttcacagtcagaaatcagataaaagataagggaagatgttggtgctaaatttctggacatgctatgcaggagtgaaatgtcagatgacaaagcaatatcaggaagaagactgccaaaggacaatcttgttgaattctgggcagaaacactaaggagagatctgaattgaaactatgttattataataattgtgttatcttcaatctgggcatggcacacacaggaacattctggcctgatgctgctcaagctctccctctttggataaataaatggcttcagttttcaaaacattctcctaaagcacttttatattcttattttttaaattgtataacacccagtacacctcagtggtcccagtctttaaaagccttgttaattttacctgtaaattttctttctttatattcttttatcgaattcatatcttctcatttatgccagtaatgttctcacccataaactctaccctaaggtcaaaatgtttccttcctcctcttttaaataactgtcaatatgggctctcccaataaacaaaccaccgccaaaaaaagaacaacaaaaagcctgtatctgggatgctatgtgaggaaataattacccttcacaaaccctatcttcaggatatttctgtattttaagccacaccaacataaggtaggatgtatttgtgtgtgttatgtttttccaccttggaaatatttttaaggaagttgggatatattatcttaaatttcattatcagagtgaggttaggaaattaaatacattgtattttaaatggaccaaggtgattcccaaacaatcataatactaatatgg

SEQ ID NO: 50761 - DNA, 2431 bp, Homo sapiens
cgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaaaaaag

SEQ ID NO: 50762 - DNA, 731 bp, Homo sapiens
agcggggcggttaactgccaccaagtggtggttgtatgccatagctctgtaacatgaacagtgtttccaataaactgtccaccgcaaaacccgttaaaaaatgagtgagctccatgagctgaggagctagcagattgccgggattacaaagacaacgagacaggaccctttccttagcagggtttacaatctctcttttaagagcctgtgccgatggaggtgccaaccgcttatatgatatcaccgaaggagagagagaaagattcctctgacagtatcctccaagacctgacatggacaatgtgtgaaaaagcgctcaacctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagaagaaacagtgaaaggaatactgttcaattccaacatcagctgtgtaaccgaggcatcgtaatacttttatgacaagtttcactacctttttgcctgtgccagtgtacctcaaagggatat

SEQ ID NO: 50763 - DNA, 2439 bp, Homo sapiens
agcggggcggttaactgccaccaagtggtggttgtatgccatagctctgtaacatgaacagtgtttccaataaactgtccaccgcaaaacccctcttttaagagcctgtgccgatggaggtgccaaccgcttatatgatatcaccgaaggagagagagaaagcctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaaaaaag

SEQ ID NO: 50764 - DNA, 2243 bp, Homo sapiens
aaccaggaaactatggtcatggtccttaaatgatgaaagaaaatcaaggaatacagagtgatcatttgtgttatatatatctgatggctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaaaaaag

SEQ ID NO: 50765 - DNA, 2225 bp, Homo sapiens
cgagcgccgagcggtcgatcgccgtagctcccgcagcctgcgatctccagtctgtggctcctaccagccattgtggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaaaaaag

SEQ ID NO: 50766 - DNA, 1047 bp, Homo sapiens
agcggggcggttaactgccaccaagtggtggttgtatgccatagctctgtaacatgaacagtgtttccaataaactgtccaccgcaaaacccgttaaaaaatgagtgagctccatgagctgaggagctagcagattgccgggattacaaagacaacgagacaggaccctttccttagcagggtttacaatctctcttttaagagcctgtgccgatggaggtgccaaccgcttatatgatatcaccgaaggagagagagaaagattcctctgacagtatcctccaagacctgacatggacaatgtgtgaaaaagcgctcaacctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccagtgagtcaaaagtgaatataatgtgagccctttccttcacaaagcttctaccacttgagtagactagaagaaaacattggccctgcttgggtcttcgaactgtgagtggaattgaacatgtgcgctttcttgtggccactttagttttgccccaggtcactgaccagcaaaaatgtgaaggagaatcctgaaagttttcattttattgtgtctaaaaaacaagagaaagtgttgtaactctaaattgactaagaattaaattgagcacttttgcgttttgaacagctgaa

SEQ ID NO: 50767 - DNA, 649 bp, Homo sapiens
cgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagattcctctgacagtatcctccaagacctgacatggacaatgtgtgaaaaagcgctcaagtatgtgttgtaaaaaaagggtctaggccagttacttcagataagagcataatgcccatgaggccaagcttatgtattgggcctgtagcctgcttgctggcaaataatctggtgccaagtattctctcatggcaggtgtagcttgtgaacgtaattgtaaccacaactgtgaaaggatctcaacactgtgccttccaagtgatctttgatcataagatctgtcgataatgcttgtgaagaaatatagactctcatattgattatttttactgaattggagtggacactaataaagataacagagcactttaaaaaa

SEQ ID NO: 50768 - DNA, 1566 bp, Homo sapiens
cgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaaaaaag

SEQ ID NO: 50769 - DNA, 2597 bp, Homo sapiens
agcggggcggttaactgccaccaagtggtggttgtatgccatagctctgtaacatgaacagtgtttccaataaactgtccaccgcaaaacccgttaaaaaatgagtgagctccatgagctgaggagctagcagattgccgggattacaaagacaacgagacaggaccctttccttagcagggtttacaatctctcttttaagagcctgtgccgatggaggtgccaaccgcttatatgatatcaccgaaggagagagagaaagattcctctgacagtatcctccaagacctgacatggacaatgtgtgaaaaagcgctcaacctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaaaaaag

SEQ ID NO: 50770 - DNA, 462 bp, Homo sapiens
attagcctttccttaatatttgttccttggggaaagtaaaataaatgtgctcttaggggaattaaaagattagttgctacattactccttcagccttccagttctaaatgtagatttctaaaattggaaggcctgtgtttgtcctgactgaatttgcctttcagagtataaagtaaaataaccttttcttcctcatgcccacaagttctctgagggacagtgccaatagctaggataagccatcccagggaatgggatattgatctgtaggactaatggacgtaggataagtgcagtggggatacaggatgtattttcaagtgccagagaaaatacgaagagccaagtgggttggcatattatctttaaggaacgttacactctttctacctctgcttgcatttttgcgttcctcttttctttccttgcacccttgttttatctttatacagttaaaaaaaa

SEQ ID NO: 50771 - DNA, 425 bp, Homo sapiens
  misc_feature (417)..(417): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (425)..(425): n is a, c, g, or t
aaacattaactcataactcacggaaacccaatgaagtcggtgctggtggcacctccattttacagatgatgaaaccgaggagaggagggaggttgaataacttggcccaaggtcacttgctgaaaagtggcagagctaggattcactgcctctggttcactgccttgaaaggaaggaaagtctccccactcccaccactggggaactcttctttaactttctccacagtatcattggtccgataaatgagaggcaaggagagaaacaaagatggatgtatgtataaacttaggcaagcatggagagccatggtgatctggttaagtgttagttcttgagctgaattgcactggttagtgtcctggattttgaatgtactaaccctggaaaataaaattagaataataataagtgtananananan

SEQ ID NO: 50772 - DNA, 5942 bp, Homo sapiens
  misc_feature (1079)..(1079): n is a, c, g, or t
cacgaggcggcacgaggaatgacttgtgccctaaacaacctcctgcacagtctgcagcttcctgagtcctgttctgaaataaaacatgaggcttttaagaatcatgtgttcaatgtagacaatgcaaaatttgtagttaaatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtatcctcattgtaccaggcatgatcactttatctttagtagcctcagttcttcctctccttctttgtttgatggagctgtgattggcactgtaactatggccacaaagaaacatttctcaattatattaaatcttctgggaatgttacttaagaaagataaccaggacacgaggaaactgttaatgacttgggctttggaagtagctgttgtaatgaagaagtccgaaacatatgcacctttattctgtcttccgtctttccataaattttgcaaaggccttttagccgacactctcgttgaagatgtgaatatctgtctgcaggcatgcagcagtctacatgctctatcctcttccttgccagatgatcttttacagagatgtgttgatgtttgccgtgtccaactagtgcaccgtggaacttgtattcgacaagcatttggaaaactgttgaaatcaattcctttaggtgttttcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttntaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaaggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatcccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataatctcaagacacctcccgagtgtctgctcactccccttccaccctcagctctaccctcagctccaccctcagcagatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcatcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaat

SEQ ID NO: 50773 - DNA, 5733 bp, Homo sapiens
  misc_feature (870)..(870): n is a, c, g, or t
cattaaatgtctttccagtgatgtatagtgcccttaaggtattgcaatgatggtttttagtctgcagggtacatattttatgcttatgttaaattgattcttatgtattttactcagatactattgtaaattggaatgttttaaaaattacatgtttctgattactcacgggtagtatatagcgattagactaaccctaatcgcaaagaaacatttctcaattatattaaatcttctgggaatgttacttaagaaagataaccaggacacgaggaaactgttaatgacttgggctttggaagtagctgttgtaatgaagaagtccgaaacatatgcacctttattctgtcttccgtctttccataaattttgcaaaggccttttagccgacactctcgttgaagatgtgaatatctgtctgcaggcatgcagcagtctacatgctctatcctcttccttgccagatgatcttttacagagatgtgttgatgtttgccgtgtccaactagtgcaccgtggaacttgtattcgacaagcatttggaaaactgttgaaatcaattcctttaggtgttttcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttntaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaaggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatcccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataatctcaagacacctcccgagtgtctgctcactccccttccaccctcagctctaccctcagctccaccctcagcagatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcatcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaat

SEQ ID NO: 50774 - DNA, 2399 bp, Homo sapiens
  misc_feature (870)..(870): n is a, c, g, or t
cattaaatgtctttccagtgatgtatagtgcccttaaggtattgcaatgatggtttttagtctgcagggtacatattttatgcttatgttaaattgattcttatgtattttactcagatactattgtaaattggaatgttttaaaaattacatgtttctgattactcacgggtagtatatagcgattagactaaccctaatcgcaaagaaacatttctcaattatattaaatcttctgggaatgttacttaagaaagataaccaggacacgaggaaactgttaatgacttgggctttggaagtagctgttgtaatgaagaagtccgaaacatatgcacctttattctgtcttccgtctttccataaattttgcaaaggccttttagccgacactctcgttgaagatgtgaatatctgtctgcaggcatgcagcagtctacatgctctatcctcttccttgccagatgatcttttacagagatgtgttgatgtttgccgtgtccaactagtgcaccgtggaacttgtattcgacaagcatttggaaaactgttgaaatcaattcctttaggtgttttcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttntaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttcctttttttttttttgtaagagaaaattaaaggtggtttttttttttaaattttgctttattg

SEQ ID NO: 50775 - DNA, 3784 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50776 - DNA, 1809 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccccataacagaacctccagggcctgcacaataagcttctttttttcc

SEQ ID NO: 50777 - DNA, 3628 bp, Homo sapiens
aagataggctaggtacgaggctgggtggggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50778 - DNA, 3633 bp, Homo sapiens
ctaggtacgagcccctgggtgaatcggccgaggggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50779 - DNA, 3264 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50780 - DNA, 3662 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50781 - DNA, 3525 bp, Homo sapiens
tcaccataaggctaagtagcagcctagggttttaatcaggccagagcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50782 - DNA, 3539 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaactcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50783 - DNA, 2751 bp, Homo sapiens
cggacgcgtgggtcgacccacgcgtccggcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50784 - DNA, 2764 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50785 - DNA, 4472 bp, Homo sapiens
  misc_feature (1479)..(1479): n is a, c, g, or t
  misc_feature (3296)..(3297): n is a, c, g, or t
cacggagctgaggaccggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccaggcaagcgggtcactgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgattcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtgggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgccccngcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaagttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccagggccaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacaggggttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctggcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttnncctggaaaggcaggctcacctgggactcaacgttccttcccccgccgccactgtgcccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaaaaaactgc

SEQ ID NO: 50786 - DNA, 602 bp, Homo sapiens
tatggctttttttacttaatcttgtgggtcaagtgtctttctataagtatagaactttcttagtttttttttcttttaaatagttgcagagtagtgtgttttatagagttgccagcatttatctagctgggcgcctactgatggactttcgtttgttctgtttgtagtcggacgaggaaggcagccaggagaaaggaggggacgacagccagcagaagttcattgctcacgtccctgttccctcgcagcaagaggtaggaccacagctaagagctgcctgggcgccgggggcttctctaaagcagacttcacagagcactgtagtgggttttcgttgtccttcctacccatccgggcagctcagggtcctgaccacatgacacctgtcattgtgttcagggtgtggggtccaaaaagggcaggaccctctgctctaggccattctatcgttcaaatgtttccaatgggagggagttaggactcttggagactattctgcgtatttaaatcagactccttgatggacttctcccacggggacttcctcctggctgggtctggcaggggttgaggggctttgctgaggagtgagccctgcactc

SEQ ID NO: 50787 - DNA, 2875 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaagtagtagccgtttctgtgagaaggcccgaaatgcagaaataggccatgacggcctttagctatgatttcgccaggctcagctggaatgagggaaaagtgacaggaacgaagacccttttctggcctcagaattgtactgaacttgccttaaagctgagaagtggagacgacagatcatgggagagatctctaaaaaagtggctcagatttcagaatgctggtttaggtgaatttcgaatttcgtgacctgaattgatgaaattaacaagctgctaagggagaaaggacactgggaggtccggataaaggagctgggaggtcctgattatggaaacagttggccctaaaatgctggatcatgaaggaaaagaagtcccaggaaaccgaggttacaagtactttggagcagcaaaacgatttgcctggtgttagagagctgtttgaaaaagaacctcttcctcctcccagaaaagacacgtgctgagctcatgaaggcaatcgatttggagtactatggttacctagattgacgatgatggcgtactggtgccttgggaaccggcactttgcccagaaacctcagagccgagtagggggcaaaggggaaaagcagagcacgagagggctccggtggcaggaggcagaaagggcacgacggaggaggaacagggaggacagagattcacttctatggcgtcaccggagggagaagtcggactacgaagggcagcacgtagcacacggagggcacacaaggccccacagaggttcttggccacccgtcccggtaccctcgcacaagaaaatttgaggacagcacttggtgccgaagggacacaaacgggggacgcctcccgaaatttttctactgcaaccccagtgggccaaaaggtagataaactccacgagtgctcggggatatataaagccccaagaggggggcacattgagaattatctacagccaggagtatacaaagaacacgagatgaataacagatgttggatgagcgacactcacactagacacacggacgcacttctcatatgcagagaaaggt

SEQ ID NO: 50788 - DNA, 5075 bp, Homo sapiens
  misc_feature (2082)..(2082): n is a, c, g, or t
  misc_feature (3899)..(3900): n is a, c, g, or t
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctgggctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgattcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtgggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgccccngcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaagttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccagggccaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacaggggttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctggcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttnncctggaaaggcaggctcacctgggactcaacgttccttcccccgccgccactgtgcccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaaaaaactgc

SEQ ID NO: 50789 - DNA, 1552 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttggatggccgggtcgtcgcttacgaggcaagaattgatacattctgcca

SEQ ID NO: 50790 - DNA, 3647 bp, Homo sapiens
tcaccataaggctaagtagcagcctagggttttaatcaggccagagcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50791 - DNA, 4577 bp, Homo sapiens
  misc_feature (2082)..(2082): n is a, c, g, or t
  misc_feature (3899)..(3900): n is a, c, g, or t
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctgggctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgattcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtgggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgccccngcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaagttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccagggccaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacaggggttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctggcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttnncctggaaaggcaggctcacctgggactcaacgttccttcccccgccgccactgtgcccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaaaaaactgc

SEQ ID NO: 50792 - DNA, 3850 bp, Homo sapiens
gccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacgccaggtgcggtggctcatgcctgtaatcccagcactttgggaggctgaggcgggcggatcacaagctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50793 - DNA, 3750 bp, Homo sapiens
aagataggctaggtacgaggctgggtggggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggatatatgtcctgccagagtgagcccttgcctgatctcttcagcagttgtgtggtggagattttatttttcctgtgaggcagcttaaaagcagctcattaatccacctagaaaagtggtctcagaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50794 - DNA, 3187 bp, Homo sapiens
  misc_feature (123)..(123): n is a, c, g, or t
tgagaaagtggctgaagaaaagactcatcggcggacgactctctataatagcggttcaaactctcggaaggctgcgtttacttggtgagagtatccggaattcgatgacctgaatactgatgnaaataatgcaaacgactgaatagccggaaaaccggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaactcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttattttagctt

SEQ ID NO: 50795 - DNA, 330 bp, Homo sapiens
aaaagagctttaacttcgataaatcaattattttgagttttaggctcatattttgtaccaattgtgttaatacaagttagaacttaaaaccaaacatttcaagtaaacatttctaaaatattagaaatatttctaataaaacatttatgtggttttgtcctcaattttccacaataagagtcaccaaaaaactttcaaataatattcacaaaattataaatgcaatcattttagacccctactgaaataccagtttatgagtgcctgtgtgtggattacgtacatgcacacacacggacacacataaactagcacatacacagaaacaca

SEQ ID NO: 50796 - DNA, 254 bp, Homo sapiens
ctgggctatgtgtggggcaactacatgtcagtatctttaggtttttccactagggctggtcagattctccggaagaatcctctagtctccttcctacaagttggaggcctggctgcctgtggtctggaagctaagtgggagaacaaggctgtagggggatcctcaattactgagtttattagatgtgttttcaaagaaggggactctactagtagtaaagtgtgaagacagggtgacagtgagaccctgtctgt

SEQ ID NO: 50797 - DNA, 416 bp, Homo sapiens
cacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaagcagttgggacagtgctcctctgcccttcataaacagactactgttgggtccctgattccagggctggcctgtgaaggattgccccaggtgtcccctttcacggttgttcacatttacagtgacttctgttgaacacccctctttaggggatgtttcttttgctcttattttcctgcatcttttccttaaggggaaggccccatcctttcccaggggccaggggttttatgacca

SEQ ID NO: 50798 - DNA, 321 bp, Homo sapiens
cttatccctatcactcaaggagttaaaagggttttagaagctctgtgccaagaactgcaggcagagaccaaatatttatttcttattgtgtcacactgttattatactgaacagttgtcagtcttttgtaaagaagagctttccttcttcgcatacccccacccctcttttaaaatgagtatcactatggacacatgatttttttttttgaacccagtgttttgtaatcctgttctgccattttctttgatgctcaaattgtcctgaatttggcctatgggtgttccttttaactagatcctgtgtccttttgacatggcc

SEQ ID NO: 50799 - DNA, 324 bp, Homo sapiens
cagctatgatttttttgacagatagacagggtgtgtgaggttgaggcttaagtggtttattggtaccagattttgaagtctttgattgactaagacatttgaagtttgttcttgctattgttattattattttgttttgagggagggtcttgctgtgtcacccaggctgaagtacagtggtacgatttcagctcaatgtaacctctacctcctgggcttaagcagtcctcccacctcagcctcctgagtagctgggactacaagcgcgtgccaccacgcctggataatttcttttttttttttttttgagacagagtctccttc

SEQ ID NO: 50800 - DNA, 718 bp, Homo sapiens
cttactgatatgtttgtatatgtctttaaggaactggtgtagagaagtagtaaccagtactgagggttaatatgctttcaattgtgggcaaatgctccagtgcatgtaattctacttattaaagttgtctttcagagctcgggttaagtgaactcaaaagttattttgaaatacagagaaatctgattaaacaggaccgtgaagtaacatagctagtgaacacttgctaaatgttcacaatgattgttttgaaccatttttgtttttttctaaccacactgaaaactaaagatactaatgtaaaatatttgtgctttaatgagaatgtattagagtcatttaaaaatattattgactcttgtataagtgatttttttaaaaaagatataagaaagaaggtgtggagaagtaaatatttttcactaatagcttcacctgcagaatcatggcatgcaaacactaagtgatcgagttgaacattttcagtgataccatgtagatattatgacttgatgtgttgagaagggcacttcacctctgttattctttccataaactcgtaactccagtcaaaatatcagaaagacagacagacacactgagagacatcctttaaaatacttgaacagcgctcagaactgtcatgaaaaacaaggaaagactaagaaatgattacagaccagaggagactaaggagatagggtgagtaaatgtaaag

SEQ ID NO: 50801 - DNA, 415 bp, Homo sapiens
aaatgtgctttgtgtactttccttgactgaggagtaatgtgggtaagagaaaggactctttgcttatttatggatttaggactctgtgctgatttatgtaagcacagttgcatttctgtgtaagcggaagacagataattctttctattaaaggggacgttcagtgtagctactgcagagcaccgtcaggacacaggcctcccaaccaatgcaggctcagccctccacagcccctcaggagggactcagtgcatctcaagggagttttatccttaaaaactagaagccatatggacatctactttgggaggatttggtgggcctcaggggcctctagcagcagaaggccctggcttcctgaacgcagacggtgcgttggcccaacatggtgcgttggcccaacacggtgcgttgg

SEQ ID NO: 50802 - DNA, 521 bp, Homo sapiens
aaaatatcccccccaaatgtaattctaatgattatactaaagtctctcatttgatgaattaaaacgtacttaaccattttcttcctgtaaagtttttaggatgattttaccactgcaaatttgcaacctgagaagtaaaaatataactttgtgaggtcaaagacagactagaatgttcaccgtattcggaaaatcagtaagatcacagaaaggctcatcagctgcctgatgcttgagtagctcactcaagtgcttgtcgttgaatgcaaaatcttgtcttaagtggacaggtgtgtgaatccttccaccgctatactctccttgcctgattgagtcaaggttgttactgtggtccctggaacagagtgtgcctcagtaaatcaaatataacaaaaggaaggaatgattttcagataggatagacagctaagatgaacaagacttttagaacatttccaatttgagcagtgaatctgccttgtggaagctcaaaatgtactttaagtgacagctgccgtgta

SEQ ID NO: 50803 - DNA, 310 bp, Homo sapiens
tgtatttttagtagagacggggtttcatcgtgttagccagcatggtctccatctcctgacctcgtgatccacccgccttggcctcccaaagtgctgggattacaggcgtgagccaccacacccggccgaatctttaattgaatacttgacttgggaggcaaatgcgtttttgttgtttttctttttttaaagaacacgctatcagaacagttctttgaaactaatgggagcaaaacagcatgtgtgggcagagagggagggtagtaagaacacacctcttgggaagagaagttgtacatggaaagaaatt

SEQ ID NO: 50804 - DNA, 331 bp, Homo sapiens
cgaagaattgttggagggagtaaattcaaaagatagaagatacggttgaagagagacaactaaattgaaagtggcagatcaaaccgaaggtaaaggtatttagtaatgacaccgcctagggtatgaccacatgcatgaataactcaagggtgtagaagatgactggcagagaggaggtctcagaaatgggaggccagatagtagaaggatcacttgtgtgcgtgagatcacaataacataatattgaaatctcaatagagatagtattagagataattataattaaaatcacagcggatctcaaagattggtctgcagactagcaaatgcc

SEQ ID NO: 50805 - DNA, 291 bp, Homo sapiens
atgaactaaaataaattaaaaagcactttattaacacattaaatattaagatctagaggcaggtctaacactctcctaatctgacaataatgaatatcaatgacatttcaaaatatctacaacaatatcacaactgtaatgcgattttaaaacatttgcctattggtgacaaagccaaggcattgctaatactgctgtggtttctttcaatcctaattataggaagtgctgaattgcagttcaaagttagtgaaaatggagacatttttcccatccaaatatatatacccg

SEQ ID NO: 50806 - DNA, 614 bp, Homo sapiens
aagtctttcataaaagttacaaattcaggaaccaggccattttctccctggatttcattttcaaccgaaaatgtcctgaggccaagcccatgcagtgagggcatctgagctgatgtggccatctacctgtggacaggtgtttccagccagctcagcaggctgggcccaggagggaggaaggggaacctgaccgcaggtatttcatcccaggtgcagacttctgctgggggcttaagcctcacttcctctgtgagaggagctgcagctcactcttgtccataaaaggccacgaggctcgcagagcggtgacatcagcccaacaggaagtacagaggaaggggcctgcttcaccagcagccactgctgggactgactcatcacccagctcccaagatcacacctcccgaggttccagcatggagcagctctctcgggctccacctgggagaggtccctgcaggaccccatcttcggctccactgggcttcttgagaaatgggtatgggccaagaaagaaaaacaggaaaaagggcagtttcaggttggacaacatgcccacgttgggtgagactgatgggataatctgagacaaatgggaccaaaactttccacca

SEQ ID NO: 50807 - DNA, 446 bp, Homo sapiens
cactgcaagtttcaaggaaaagtagttcatcaagaatgatcttttagttctgcaatcatcaaatgtttattgaagttcctgtgcaaatagacctgaggttctgtgacttagtcacagtcaaactaaaacaacccagcagatgccatgtggttgggtttgagaacacaaatcatgcagtggcatgctaacctgaagtcccaatagagtctacatcaattggggagcagtggcaatgatgaccaatatatccatgattcagacatgtattatgaatggtctgcgcagaatttatcaacaacaaaaactccatgaatcctctgtatggggagtttctgtctttctagaccagcacccaaagactgcacatgtcatcaaaccacagccaatgttccatggagaacactatctgtgagttgaggctgcattgtgcaaccaaagaggcacag

SEQ ID NO: 50808 - DNA, 1859 bp, Homo sapiens
  misc_feature (454)..(454): n is a, c, g, or t
tttattagctatatcaccttggagatcacttaatatttctgagtcttcatttcctcatgtataaaatgaggaaaatgacattaccaccttcatggggctctcaagaaaaacaaaatgaggtaacaattgtaaagagcccgattcacatgctaacatacacagtaactgtaagctgtgtttgtcgtcattgtttccccactatcagcaggagggaagagctccaggtaccctcctgtttgctccttcttgtggcacctctcacctggagtaatgtggaggggacccacattagaatgccccttccctgaccctatgataaggttcaagccctaccctcttttggggtatatctgggaagggtgctcacccagcttctagccttccttcaactccacctggacattggagccagagctgtgcagcacagtgagtcttaggggtgatttggttgcanggagaaactgcctgctcagaccagctaaagagaagtttattgctaggttactgggatgtccctgtgcctactttttctctagggcagctggtgtctcctcttacttgcctctatggactggttttctgcctcaggaggtcaccctagtccaagtcgaaaacattcctcagtttgcttgtctaacgtcaattaacaagttcctctgtgccctaattacaaattcccctgaagaaaagcagattggccccagtaggtcagaggtcaaccatggtccttgcagtggggagtctgggctgtgggtgggtgggcatgtttcatctcactgatggggtagacaggtcacaaaaaggacacctggacaagtcagtcacacccacaggtgacataattttctggccttctggcaggagggaaagccctctcctcccatagcctgctctgccaggcatgtgcagactgaggctgttaggtcttctggagtttgccagaatagacagccttctgcatcacaggccatgcatgcctcataaaatcctcacatggttccagatctctggattacacaaactgatgttacctgaacaggaagagtagtcatatataggtgataggggagatgattttaggtgtacagtgacacaatgttttatactgataattatatgctgtatttggaaaacttataactaaggatcaaacccacaatttcacaatcattacatagaaaatttactttcattatagatgtaagtaataatgagtttcttataaaaatttacatagtatggacttgattttttttttaaagtgaaggtgggataattgaatgatgaaagttaagaagccctgactggtgttgcatacaccagggttcttacctgtgaacctgtgggaagacttcaggaggcctgtgaagcccttgaagttgtagacaacattttggatttacttaccggtctgccgttgtttgtggaggagggagagtgagtcatcgcttggtttagaaatttagtgttggaactttctgggggttatttattaaaggttccaatttccttccccagagattttgatgtagcagtggaaatggaatccacgaatgtgcatttcacatgcatttagatgaggagtgcaggtggttctcagacctcacattgaggaacactgcttatcaagagtttcaggagaccccaacgttgagaattcagttctgagccatcccaacttcttaggattgttgtgcggtggttaaaactttcttgttaagagtttttgagatctttggacgaaaggtttctggataaatttatatcacaaattagtaagggtttcatagtaaggtggctttcttttccctgatcagtcattttgtggttgggtttgatctttttagtccaagatgctt

SEQ ID NO: 50809 - DNA, 354 bp, Homo sapiens
aatagtattattagacccacttagggccaataaaagctcataggttgtcaaaactgttttgtcactttggttgcaaggggcagaatttgattcttaaaatattggaattttatattcttattataaatttgggggaaataaaagataaggagttgccataaatatgtgagggcccacaacatcagtgtatttcttgttgtttaaaatctttctttaggctaggtgtagtggctgatgcctgtaatcctagcacgttggaaggcaagacgagaagatcacttgagcccaagagttcgagaacagcctgagcaacatagcgagaccctgtctcaggggaaaaaaaaaaaaaagcct

SEQ ID NO: 50810 - DNA, 456 bp, Homo sapiens
atgtgtaaggatgtctattacagcattatgtattttaattttgcagcaaaaaaaaaaaaaaaacttggggaaaaaaagaaatgtctgtgtagggtactggctaaattggtaaactgatatgaaataaaatgctgctattaagaaaggtgatggatacatatgaactcacattttaaaatgtctgagatttattgtagagggaaaaagtggaagtctgtatggataatattattttattgatgagaaaaaaattagatacatatacaaatgcatgtatattcatagcattttctggaaggatatataatatactgttcagctaatatataatttaaggattatgagtattataaattgaaattaatattattacaaattaatacaaattaagatttgttgatgtatacatagtattatggtaaaatgagtataattaaattattcaaaagtttgctt

SEQ ID NO: 50811 - DNA, 434 bp, Homo sapiens
ggtagcagggctattgcttcctgttaaactctacctgccaaaaggtaagcactgaaaggcgctggcaggccaagtaaggccacagtcatagtgcagtggctgtgttgaaacttccagggtaggctgctgcagagaaccttgctttctgcccagccttgtgtgctggatgcagtagaatgggcataaggggtgtgtgctctttccagaataccgcactgttagagaatttggaggctatggtcacagaagttaaatatgtgccgcaaagaactgctctgatatattatgggtttatctgatatctcttcaagggtcagggaccatgtcttattcatctttgaatcaccacaacttggcacagagcctgacatgtagtaggagcttaaaaatggtttcgttatttttttaaaaaaatagtgaatgaatttaggaat

SEQ ID NO: 50812 - DNA, 188 bp, Homo sapiens
ccagtccacggggtggctcaggaacggtgttcctggcagcgtggattgcaaatgcaaaggtcaggaggtgagaatgaacttggcaagcagaagatgagctcagcagccgcctgactgccaggcctggagagtgcccaggaggagtctgaatattatcctgaatgtgatgtcccaagcaggctcttccc

SEQ ID NO: 50813 - DNA, 467 bp, Homo sapiens
aggtgcaaacagtcacttgggatggacttatctcacgtgctaaatccagcagttaccaagagcaagaagtgtttgtggtgagaagctcgtaaggtcttgacccagcgagaacgtttccccgaatcaaatctccatgaacctaacacccgtttcccgcctcttgccaccagtgggatcttgctaacacagaaggcagccggggaggaggagagggcgtagtgaaagactgagccagtgtggagcctgttggcacctgcaacgcttactttaaatgctctctggacgggctcagtgaggatctgctgactgaggccaggcagcccgtgactcgcactaggagatcagctgctctctctaaaccagccggattcagctctggatgcttgattctcattccttcactgcaactattctgctgaggacaagtttctcaaggccctgccagtttggtcaacctgaccctctgg

SEQ ID NO: 50814 - DNA, 179 bp, Homo sapiens
cccaccatcaacttcctcgcttcctagccctctcttcccccaccacagtttccatagagtctccagggtggacacttggcagtgacagttactattgagggaatactctgacccttccttacctacggatacaggcttagggtttgtcccacctttatactctcttccaccaaatccca

SEQ ID NO: 50815 - DNA, 394 bp, Homo sapiens
tgaaattaagtggccacaatcagcccaagggaaaccagaagctctatttttttaagctctgatgtttgaagttaagaagattggagaagagatatatctggaaaaatcttcagattttataattaatagtttagcattcatgttttatattataattttatattttgctgaaaaacatctttctgaggctgaaactatgaatattttttcagcattcttttgcacctagatttagttcttcagtatcaattaatctgaaagtaattttggtctttccatttctcatattcatcttcagttgaagaggagcaaattcactgctttttagaaacctaatctcagatatcagacagatggaattaaataaacaagaaattttattccactactcttc

SEQ ID NO: 50816 - DNA, 547 bp, Homo sapiens
gaagatcaaagcagaggaagccacacaatgcagagaatcaacagtggagctatgcctagtgagaagcaaagagacactggatggcctgagagggaaagagactgagaaaagctgtcagcttttagttcctggttccagtcctttgtgacggccagcttgattagagagaaaaggtcatttggaaaatatagccatttttggaagactgagcagccaaggttcttaagtataggagattgggacaaaacaaaaaaaaggtttataacagttcactacttcatctacatcctcaagccaacacctatgaaaaagataatggtgtccgatgacaggcctctgctaacagtgtaaggctatctgtgaactcctcagtctacacatatcttcctcagcctctgggattccatttccacccaagaattaaattgatagaaagaaaaacagcaaaatatacacatatttttccactattaaatccaataatgatgacttaatttcagcaaaacatcatcaatcgcattaaattaatgttgctgttaatttgaat

SEQ ID NO: 50817 - DNA, 616 bp, Homo sapiens
taaatgatcatttggtccattaaaaaaaaagtagcaggctttccaaatgtaccaatattggtaaacttagaatccagccaggaaaatactaggaagacttgctgctaagtttcctttgcttaaatttttaatagttatatttaaatgtataaaatcaaatatatttaaatgttttaaagagttctttttaaaaatagtttatctaaatcttagcagcgtggattgatgaaaaacttagaggcatactattttttattatcattttttgataaatatattttcagaggcataatttggaggtagtattaattagtaaatcaactgtcaatgtcaaagaaataaatacagaaagagagagagagagagagaaatctaccaatattttaagttttaattggcaaaaattgtgaagtattaaaagtatcaaaaggtaaaataaaacataacgatgcttcctgtattaaaatatatagccctaggacaaaattttaattttacaatttgaactttaatcccaattgtagtctgtgatttatgataataattataacaatcattatcccctttaaaattatttattcaaaaagcctagtgttatagtgaacaaattataata

SEQ ID NO: 50818 - DNA, 1048 bp, Homo sapiens
gtcttactattatggccgaaaggaaatctgaggccaagaaatcgaatctcttttttcctaggaaaactctgagctccttttagtgagtgaaaggagaacagtactgccgtttgagtcctgtcgacattgtagccagcccctggcacagctggacgtgtttgaggggagtgatgcacgtcttttatagatacaggaaaatcttcgcatttgcaaattatttttataattgagacactggcaaggaatgaacatagatgtatttctgatttcacttcttgaaacatttcttttcatccataaaaatgatgcacaaaaaagatacttaacctgtagttaaatacagattacatacaaatgaaaccacagaagcaaacagatgtacaattcttctatcttttgagtatttttagatagactgtgtgactttaattgaccttagttgacctcggtctctggaccttcgttgctgcttctgtaaaatggaaataaaaataacatcacctcataagtagggatgtatgcagagcccttcacacgtggtaggcactccataaacagtggctgtcgctgttattttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtatgccggtgatacatcttttccataataaagagttagtcactagtgatcttttactgggttgtgaaatctggcctcatttaaagttttattacttattctacagccattttccctaaactgtcctactagtaaacagccaaactca

SEQ ID NO: 50819 - DNA, 414 bp, Homo sapiens
ctttttcataacatgtctaagtaggatagctctgttgacaagtaacaagatgaaaaacattttaaaagcaaacaaactctgtcaaagaagtgaaaacaaatttatcaactaaaggaatattttagcaaattcagatacacttacaaatagaattatttttgcatatactaattggaaagaagtagaaatttttcagcttggccttcattcagaaagtgtgtctttaatccccttacagtagctgtcatacatggctcatagattcatcactcattgaataaaatggtgccaagaacccttgatacaagtgaagatgatatgggcctgtcttctcagcttgcagtcagtaagaactatagccaagttctgaaagggttattgaaatagaatgtaacattgctatggaagggtcca

SEQ ID NO: 50820 - DNA, 436 bp, Homo sapiens
tgggctgatcatgaggtcagaagtttgagaggagcctagccaacatggtgaaaccctgtctctacaaaaatacaaaaattagccaggcgtggtggcgtgcatctgtaatcccagctactcaagaggatgaggccagagaatcacttcaacccggaggtggaggttgcagtgagctgagatggtgccattgcactccagcctgggcgacagagcgagactccgtctcaaaaaaaaaatttttgtttattatctccagtgtccagcattgtgtcctgtgtgtatttcaggtttgttgaattataaattcatgaataactaattatcccaattaattgtagggcaaagatcaaacctagaaattccctgaggaatgttcccatttggtcagtaggtggcagtcttgcctattttgagccggctacattcacttcgtgat

SEQ ID NO: 50821 - DNA, 469 bp, Homo sapiens
tgaaagataccagccttcctcatctcaaaatcttttatggaatcataatttctgtagaaatctgcgtatgccttctttcttggttcggccatagcaatcttgtagaaagctgcaaccaccagggataccatgaatgctccaataatatgaaatcacagacgcttaaccagaaggctatgcattggaggttttgtcaaagcaccagaagccatggtagttactgtccttgataggtgtgtaaacttcaacaccaacatccttcccagctgttggagaaatggacggtccccacctacattttatagacagtccattcataaaactctcctcctgccagggcacggactgatgtgaatccacctaatggccctaggcaataggtgcctttattgtcatccttgttttacgcatcagaaactgagagacagagaagctaagtgagctgcataaagccacagagctagtaatt

SEQ ID NO: 50822 - DNA, 1411 bp, Homo sapiens
gaataatttacactggtatgtttattttcaaaaggctggcaaaggggatcagaaatgggactttttactcaagggtcctgatatgagggaggcagggtagtgagagaaggtcactaattctttggccactcaaaacattaacaatgtgctaccttgactctgtaaatcattgatgacatctttaagttcacctgaaataacaaaaagttgggtctgtaagggaacctagtagcctgtgggcatgcttgccaagcactgaagtcctatctccccacttctcctacagataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacagcataaccttcacgaaggttttatctgtttgtgtttgggtgatcatggctgttttgtctttgccaaacatcatcctgacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattacactgatgtgtaggccttttattgtttgttggaatcgatatgtacaaagtgtaaataaatgtttcttttcattatccttaaaaaaaaaatcaaaa

SEQ ID NO: 50823 - DNA, 1520 bp, Homo sapiens
ttacattagcaagagagcaagttgttccagtagtcgcctggcaggagaatttgaaagggtgccccaaaggacaatctctaaaggggtaagggagatacctaccttgtctggtaggggagatgtttcgttttcatgctttaccagaaaatccacttccctgccgaccttagtttcaaagcttattcttaattagagacaagaaacctgtttcaacttgaagacaccgtatgaggtgaatggacagccagccaccacaatgaaagaaatcaaaccaggaataacctatgctgaacccacgcctcaatcgtccccaagtgtttcctgacacgcatctttgcttacagtgcatcacaactgaagaatggggttcaacttgacgcttgcaaaattaccaaataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacagcataaccttcacgaaggttttatctgtttgtgtttgggtgatcatggctgttttgtctttgccaaacatcatcctgacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattacactgatgtgtaggccttttattgtttgttggaatcgatatgtacaaagtgtaaataaatgtttcttttcattatccttaaaaaaaaaatcaaaa

SEQ ID NO: 50824 - DNA, 466 bp, Homo sapiens
aggtgatccacccacctcggcctcctaaagtgctgggattacaggcgtgagccaccgcctgtaaattttgtccttttaagtggagctcccatgaaggcagtcaaaagaccccagtttttaaaagaggatttcacttccctttgaccctcctaggcagataagaacagggagaaattcttgcgtacccaccccagacttgccagaagcctcgtggcccaagaagtagccccgtgccctggctgcccctgaggcctcctcacacccaggagcatttgatagcttgcccacccctgttctgtgtctcctaccactccctccatgccagcggcacgtttcattatggtttcccacatccaaacctcatagcaaatgtaattgtggtgataataggtagtctagccagcaacactaagtattaaaaatgactcaatgttattttggtatttaactttgtaaaagaaaaagg

SEQ ID NO: 50825 - DNA, 176 bp, Homo sapiens
aaacaaaagagtgagtaatagtttaaaacagtgatgaagtatatcaaataaggactaaaaagtgttcattagatttggtaactagaatggtcattggtgaatttcattgggaatagttttttgtggagtagtatagtgagaagctatgttgtcttaggttgggaaataaatgtggg

SEQ ID NO: 50826 - DNA, 652 bp, Homo sapiens
gtcttgctttctttaggtaaagttttacagtaacctcctttgtagtcctttgaagatgaggatttgagaaatcccaactcctaaagtaggggagagacagcagcagaatatgacccacagccagacccaaaggggctagcccgacccctgtatatattgtacctctctctctgcccacctctcccccacttctccccactgccccattctctcttatcctgcctattcctctcccctatttctctgtctctctctctctcacatacacacacactcactcacaagcagtacagtcactaagttggctaggtaatatccaaagcattctgattgtcctactttttgtaaattgaacttatttaagatattttagaagagatgagtcacgtcttcctttgacccttcacccataacacacataccattctcacaggaggccacatggtgcagtagagtcagactttgattcaaagcccaactctgtcacgtgacagtaggcttgagtttcctcatctgtaaaaagggaagatttcctacttcataaagtggttggagaaattaaagaaatagtatatgaagccttgcacataaaaagcatttgatatatattaatgcccttttgcacaagaggtcaagaattgcttgggttcta

SEQ ID NO: 50827 - DNA, 517 bp, Homo sapiens
ggtcccttctccctcttccctccagggaaatatgggaactgtgagaggcagcaggcaagttatgggcagaggcagatacaatgagttcatgtgggaaatttctggtcagactagctctctctctcacatacacacacactcactcacaagcagtacagtcactaagttggctaggtaatatccaaagcattctgattgtcctactttttgtaaattgaacttatttaagatattttagaagagatgagtcacgtcttcctttgacccttcacccataacacacataccattctcacaggaggccacatggtgcagtagagtcagactttgattcaaagcccaactctgtcacgtgacagtaggcttgagtttcctcatctgtaaaaagggaagatttcctacttcataaagtggttggagaaattaaagaaatagtatatgaagccttgcacataaaaagcatttgatatatattaatgcccttttgcacaagaggtcaagaattgcttgggttcta

SEQ ID NO: 50828 - DNA, 180 bp, Homo sapiens
gggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcaccttt

SEQ ID NO: 50829 - DNA, 686 bp, Homo sapiens
atagcctcagaggtgctccttgagctgtttttaagagggatgaggccgaacttcagaattcctttttcatttctgtcctccctaccaccgtcttctcatcaccaaacacacagaataggagaggagagggaaagaatccctatgtaatgccaaacttgtaacagcctggctcggtttctagtgttggtgtcctgggccaactggttctgaggtcgcggggggagtctccaccctgcccctcggacagcacgaagccttctgtgacgctgcaggcatgcgaatgtcttggggaggtcccggcccctcagaaactggcaagtccagtttcaggcagaggcacaggccacactcaagaccttggatggaattcagggtatttggtccccgagtcacttgatttttaaaagatggtttccaaatgaaagtttatgtgcctataaacactgctaagagtgcagccttccagaaacataattagtgggtggaaaacaaaaatgctgtctgcctaggatttcagaaggcctgtaatcgattggtggagagagtgagacaggggactgttttctccacttcccatggcaacttaccgatattgggaagggtcattcatttgcacgtttgacttcaccagagcttgtggcccctgtactttagcatctgtgttaaaatcttccaggtagatgaaa

SEQ ID NO: 50830 - DNA, 388 bp, Homo sapiens
gcaccagggttaactcctgataaacccatcataagctgaaaatgctgtaagttgaaaatgcatttatctctcttcagccaggaaggaagggaggaagggagggaggaaggcaggaagggaggaagggaggaagggaagaaggaaggaaggaagaaaggaaggaagggagggagggagaaaggaaggaaggaaagaagggcacttaatacaacctaccaaacatcacagcttggcctaacctaccttaggttaggtagcctacttttgcttaggttagtttacctaacctaccaaacatcatagcttggcctaacctaccttaaacacatttggaacacttacataagtctacaattgggcaaaataatctaacacaaagcctgtttta

SEQ ID NO: 50831 - DNA, 524 bp, Homo sapiens
ttcttttaaattattgaattttttgccttgtggggtttcttaaccacaaaacctatctattaggattaatggaggctattttttctttaccaattgctatataactacttaagacttcatgtaatcagctgagatgctacaaatgtattgcctgtcaactccagtaaaaaagcgggcagttaattaaagggatgtcttgctgttaaacaaacttgcagtcaattgcttgtaagtaacatttagtttgatatgtagtcaaagggcaggaaaataagtgtttaggcaggactggctttttgcaacgtaaaaaggagaagtgattatattgggggtcaagatgagtaacctttcaactgggcatattttccttcttaaaaagtatattcacatatcagaggaaaggtgaaagacatataagggccttaaggttggtcagttttgagatcttttccacttacagtaactaagtcctcatcttcttgcatcccttgaagacactgttttaccctaatataaagcctggc

SEQ ID NO: 50832 - DNA, 353 bp, Homo sapiens
gaacaagagccccaggtgcccaccctcctcagagacagttctgtgcgaaggatagaccaaaccaagcaagcagacaaataaatcacagtaattgtatgaggaggaaaatcagcaaggaaaccagcagtcagtgtgcggagagctgttccccagatggagtcaaggaagtcttcctgcagaggtgacgtgattgagacgggagttggggaaggtgcactggaagctgggtgggtctcagagggcagcctggtggtttattcggcctggttgtgtgtgccaggcacggccgagggcactaaaggaagggtgcctcactgcagaggaggaggaagctccagtgccggcaggctcct

SEQ ID NO: 50833 - DNA, 444 bp, Homo sapiens
tatgagtataggcttgagcacttcagttctagaaataaacctagtaggtaaacagcttcctgcgattaaatggctagctctggagtggaagaagcttctggtattcagggaacaccttactggtacattctgcattcatcgtggtataattagggacacatcacaagctctccactttgacttttggagtggttatttattacttggtgttcaggaagagggaaggccagatgagaatggaccccctccccacacaacttgtctgtccaagccactgacacagtaactgttcctcaacctcactgctgattgagagtagagctagctaacaccaaaccctcgctcttcctctaggtcagatgctgggcttgtggcaacagttccaacaacaagctgactactatatacaaatgattcatttccagccttctgctttcctttaaa

SEQ ID NO: 50834 - DNA, 2287 bp, Homo sapiens
ccctgcacttgggagccggtagcactcctatcactgcttctcaacccgtgagctaccagctgtgtcatgagctgcagacagttctcctcgtcctacttgagccgcagcggcgggggtggcgggggcggcctgggcagcgggggcagcataaggtcttcctacagccgcttcagctcctcagggggccgtggaggagggggccgattcagctcttctagtggctatggtgggggaagctctcgtgtctgtgggaggggaggcggtggcagttttggctacagctacggcggaggatctgggggtggttttagtgccagtagtttaggcggtggctttgggggtggttccagaggttttggtggtgcttctggaggaggctatagtagttctgggggttttggaggtggctttggtggtggttctggaggtggctttggtggtggctatgggagtgggtttggggggttagggggctttggaggtggtgctggaggaggtgatggtggtattctgactgctaatgagaagagcaccatgcaggaactcaattctcggctggcctcttacttggataaggtgcaggctctagaggaggccaacaacgacctggagaataagatccaggattggtacgacaagaagggacctgctgctatccagaagaactactccccttattataacactattgatgatctcaaggaccagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctagtcttcttcctcaaaatctggtgaccaagatgagacaaaaggcttcctttcgcgatactagagcctctgtaaacttctcctgcccagcccccagctgagcatccccagatgggcagactcccgatgaagcctgcttattggatcctgacatcaggaatagctggcaacaagcccctgtgcccgtttgggactgaactgacttggcatatgtgctctggctttccattggcttccaaccctgcttggctttggatgccttcagggttcccgagacagacctctttcctctctctggcctgggagctctcacaccctgcacgatcttgactataataaagcttccctactgc

SEQ ID NO: 50835 - DNA, 391 bp, Homo sapiens
gtcaggtaattttgagtgcatactagataatgtgaatttaccctgttgggtgctaaatatttgctttgctaaataaatattcttgagactattgggggattcagttaagttacttaaaaccaattcgattctcttgagtatttatgctttgcttatgcagtgttcactttgtctctggctaattttttgtgggtaccaaagtaaggcccttcttacttgtcacgtgtgttttggcacagttacttctaagcatttcaggcaatttttccctcacctcaggtgaatttctcttacatgtatctgaatctatactcagatctgtaaggtatgatgagaaatttgcacatccgcaatgtcttttctctgcacagctttttgttcgttggcatgt

SEQ ID NO: 50836 - DNA, 1378 bp, Homo sapiens
  misc_feature (72)..(72): n is a, c, g, or t
  misc_feature (77)..(77): n is a, c, g, or t
  misc_feature (258)..(258): n is a, c, g, or t
  misc_feature (261)..(261): n is a, c, g, or t
gaaaaattgaggcgttttctttctctcaatggagaattccctggtaaattaggaccagtcaggggggcgttngttgnaaaatctacaatatgctctttgaatatgattgcagggcctttcttcaaggtgtttgattcaagtagctctgccctgcgtattggctagctgcaaattgagagaggggggaacaattctctactttgatgcatcatctcaggcctctttttaccaggtgaattttctcttaataaaacaaanaanatttttgtggattgcccatctcttttgactctgcagactctgtaaccaatttttgtatgttaatcaggccaatctgtggagtaggcttagactgcagcctgggcaatatagcaagacctcgtctctgtaaaaagaaagaaagtaataaagactaattgagcccaaaatgtttcactatttcaaaaaagatatttaaattgttgctctttcattccataaaaaggatctgatctctctcccacttttctgacctgagttagagcttcccaaacctgtcatgtatgggttttagccaatttcttttagatcactaaaaaaactcacccaatatgtcaaataatggatttatcatagccagtacatgttctcaaggcaagtttaaacattattttgaagctattgataattttttaaaataaagaaatattcactgatttttttcactgtaaagcacgggagggctgctttaacaacagtataagaatcagcctgaagccttgttactgctacaacaaattcattttagactcctcggatgtcttccacagtaatttattcttttagcaaacctgatactgataactgtttctttgctttgatttcttgatgaattattttggtatgtttgttgatttttaaagcaaacacggataatgcactcagagtacattttttgtaaagatttttgcaatagaagaaaagtgaagtttttgtggggatgtggattttattgcttactactttatagtaatcaaaagtttgaaaatatcaacttacagtctttaccagtttactaagggaaacttttttccctatttaaaacatgatcttagtcaacaattttatttataattatcagctaaattacatttagtataatactcaaatggaaaaatcagtagtttatacctttataaatacagtttagtaagccaaggaatcagggaaataatcctttaaaataatgtactaatagttaagatgtttcaggtgttttttctgattaaatttgctactatatttggaagactttaaaactatattaaaatgtgacttgcattacaaatttctgtgtcttaccagtatatttgtaaatatattattcattttccttttc

SEQ ID NO: 50837 - DNA, 1231 bp, Homo sapiens
taaatatcatggtgtcccttagcatatactactctcattgctggcagtgagacaggccattcatgatcttaagagttgccatttttaatgtatattattagttacaagcactttatatagcagaaaattgtttttgagaataagctagtgttgatattttaatatttttagcttactgctcgtgtttttgtttttgttttcgagactgcagcctgggcaatatagcaagacctcgtctctgtaaaaagaaagaaagtaataaagactaattgagcccaaaatgtttcactatttcaaaaaagatatttaaattgttgctctttcattccataaaaaggatctgatctctctcccacttttctgacctgagttagagcttcccaaacctgtcatgtatgggttttagccaatttcttttagatcactaaaaaaactcacccaatatgtcaaataatggatttatcatagccagtacatgttctcaaggcaagtttaaacattattttgaagctattgataattttttaaaataaagaaatattcactgatttttttcactgtaaagcacgggagggctgctttaacaacagtataagaatcagcctgaagccttgttactgctacaacaaattcattttagactcctcggatgtcttccacagtaatttattcttttagcaaacctgatactgataactgtttctttgctttgatttcttgatgaattattttggtatgtttgttgatttttaaagcaaacacggataatgcactcagagtacattttttgtaaagatttttgcaatagaagaaaagtgaagtttttgtggggatgtggattttattgcttactactttatagtaatcaaaagtttgaaaatatcaacttacagtctttaccagtttactaagggaaacttttttccctatttaaaacatgatcttagtcaacaattttatttataattatcagctaaattacatttagtataatactcaaatggaaaaatcagtagtttatacctttataaatacagtttagtaagccaaggaatcagggaaataatcctttaaaataatgtactaatagttaagatgtttcaggtgttttttctgattaaatttgctactatatttggaagactttaaaactatattaaaatgtgacttgcattacaaatttctgtgtcttaccagtatatttgtaaatatattattcattttccttttc

SEQ ID NO: 50838 - DNA, 671 bp, Homo sapiens
ttataataattctttttcatgttgaaatcatgttttgaaaacattaaaaacattggatttaataaaaggtagatacaccccatagaaatgaagctggatgaagaaggaaaataagtcagcagaaacactttgaatcaaaatattctgaataaaatcagaatattctatgatcttttcatttttatgccatttctagaaattttaaaaatgttggcaatggtgctatgtataatatactgcactagattgaaaagaggtagccactgtaattgaaaagattgctacacatttgaatggaccaaatgtgttttaagaccaaattcaagtaaaaaggatgtgtctcttctgaactgaagctcattaaatgtttcaccggccttcctgcaaaaatggattttcaaaactttggaaaggatagcatttaagctgaatttgacctgtattgaccattttggaaatcagccaagcaattcgcttgaagatacttgaagcacttgaaatatggaattgctggaaaaagaataagacagcccaatagctaccattgcccagggtgatactttggtaacaggactgatggcttgtataacaatctgacatgctgataggagttggggagtgggggcagccattgggaagggcaaagggaaccctaagagtagttttttctc

SEQ ID NO: 50839 - DNA, 1669 bp, Homo sapiens
cccgcgggggcgcggccagcgccagagtagatacctgtcccgcccgccgcggccagcagcctcggaggaagccaggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgactgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaactattccctcctggacatgaggccaccaccacctgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacac

SEQ ID NO: 50840 - DNA, 1257 bp, Homo sapiens
tccccagaagctggggtgaggggtacagaagaggatggctgctgggtatgcaacctagagtcagtcagtcacaaacatggcaggaaaataagctgtctgaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgactgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaagccatcctgctgccctgcctgtggcctccaagggttgccctttagatctctggtgagccatccccgcatcagcagagccttctgcctccccgtctaagtcagaatcttcctgtgtggctgccttaccttgcaaatggccagacttctcctctgtgtctccggtagctcccagttccatccacatagcaagggactacacagaggcatgaagcaacgagtggatgaatgtctggctgatcactgtcaaagcacacgtgtaggaaacctttattgcaattgtttgttaataaagccagatctttcaa

SEQ ID NO: 50841 - DNA, 1594 bp, Homo sapiens
cccgcgggggcgcggccagcgccagagtagatacctgtcccgcccgccgcggccagcagcctcggaggaagccaggcaaagagggccggcggagaccaggtccgcgccggaggaagccgcgcccggccgaggccccggaccctgcgccccgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagaatatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgactgtgtgcttcctgtttgtcttcgccgcgctgatggagtatgccaccctcaactactattccagctgtagaaaaccaaccaccacgaagaagacaacatcgttactacatccagattcctcaagatggattcctgagcgaataagcctacaagccccttccaagccatcctgctgccctgcctgtggcctccaagggttgccctttagatctctggtgagccatccccgcatcagcagagccttctgcctccccgtctaagtcagaatcttcctgtgtggctgccttaccttgcaaatggccagacttctcctctgtgtctccggtagctcccagttccatccacatagcaagggactacacagaggcatgaagcaacgagtggatgaatgtctggctgatcactgtcaaagcacacgtgtaggaaacctttattgcaattgtttgttaataaagccagatctttcaa

SEQ ID NO: 50842 - DNA, 593 bp, Homo sapiens
tctctctgcagaccttccaaatcagaaactccgaaggtggggcatagcaagctttgtttaacctcacctccacatgattctgatgcactctaatatttgggaaacactgctacagaactgctagattagtaggagaaaagatattaatgtatattaattctggatatcagctctcaccgataacatttgcattttaatagatatcttccatgctgaagcaaacatagtaaaatattagtataaaaagtgcagggaccaaagattatcatagactaagtggcttataaacaaaataattttatgtcttacagttgcagaggatgagaagttcaaaatcaaggcactggtaggttctgtgtctgatgaatgcccacttcctggttcataggagctgtctttttgctgtgtcctcaaacggtgaaaggaagctagtgagctttctgaggtttcttttgtaagggggctttttaacccttcataagggctccaccctcatgacctaatcacttcccaaaggcccaacctattaccatcacttgggttaggatttcaacacatgaattttgagaaataaaaactttcaatctattgca

SEQ ID NO: 50843 - DNA, 371 bp, Homo sapiens
cacttttttccctagatattactctaggaaaatttacaacctgaagcaaggagaaataagatttctcttctaaatgctgaatttgaaagttgcagaggatgagaagttcaaaatcaaggcactggtaggttctgtgtctgatgaatgcccacttcctggttcataggagctgtctttttgctgtgtcctcaaacggtgaaaggaagctagtgagctttctgaggtttcttttgtaagggggctttttaacccttcataagggctccaccctcatgacctaatcacttcccaaaggcccaacctattaccatcacttgggttaggatttcaacacatgaattttgagaaataaaaactttcaatctattgca

SEQ ID NO: 50844 - DNA, 569 bp, Homo sapiens
taaggatttcattctttgttacaatctccatatctctcatagttcagagataatagaaattgtttttaatattcattcattcattcaagaaatgtttatttaatactcattatgggataggccctgaggaataacatagataacataccttatattttaaaaagctagtagctcattttaatttcatttcagaataactttgtagctgcaaaataagactagtttaagctataaagtcaattagcacaccagtgagttttggggtaggctagatggtaaacttcatctttccaacatacttagctttatttaacttgatgtttctgaagtgttttgacctattcagccatcacccctactgaacccactttcagaaataatagttaagtatttgctaggttttcattaactggaactgaacattattaggttaattatatgatatttatagggcagaaatggtgcatatcattgtattttatggcttatcctaactagttgggtgatactgtcttaatttgcctaaggtagttctggtttactcttgtcgctccagtgtgattattata

SEQ ID NO: 50845 - DNA, 1156 bp, Homo sapiens
acacaaaaattatgtcctaagggacaagtgacaagagcccaggaggctgaggaaaactacctcataaaacgggagttggccaccatcaaacagcagagtgatgaggccagtgctaagctggagcaagctgaaaataccatcaggaagctccagcaccaacaacaatgggtaaggagtctggtagtgcttttctcatctttctcatcccccttcctttcaatcattttttttttcatagcacagattttgtgctgttgttttaaataattttgttttagactttgaacttttaaattatacaattttatgttctgtgatatttaggggtcttattgtggcctaaggactcctgttctaattttttttctgtctacatagttttgttagaaataggtaatattttctttccttacactgtgttttaagtaatgggaaataagcagtgtatgtcagaattgcttttaagtttttagaaatctgttttcataataggtatcattttgctaacagtaatttttaaatcccaacttcagctagtttttgttcattgtacagatgaaacattatccagcatgcagaatatatgcagttatctcatttaaagcttcgacagtgtggcaatttgtgtcttacgaaatactattgcttagacttcctacatcaagacattgaattatgggttaaggtgtatgcctatatttcaaagggagagaagttgcaaagatgaaaaagattaaccctttaaaaattatcttaattaacctagggtgtatttctaattatcttaatcaacctagggtgcgtactaaacagctactaattgtacatctagcctcaggtatcttttgcagcttagacattttccattggcaaattcagacaagggcgatcttaatcaggaatatgagggtaaaagaaaagccaactgtttatctttgaaaacatattatttcttgtttcagttttccatcctcaagtaggcgctagattgtaataagtaagcagaagaagttgtgttaatcctggaactctatgcagatctggaaggcaaatagagtgactgcaaagtaggacgttctttttattcaataaaattaagaaacagcatcgtcatctcggtacaaaaaaatcagaaaaccagaagcaaaaagaaaaa

SEQ ID NO: 50846 - DNA, 238 bp, Homo sapiens
caggagcattatgatctttaggagggtgggcttggttcctctgtacaataatgggtcataaaactgagtggtcaagatcatcccggtgagggcagtccgtgtgttgccatagttgctgtaccggttaagaatgcacctggctgcaatttcctgaaaacctgacgtatagtggcttaaacaaagagtggtttattttccttctgtcatagcaatctgggggaggccactgtggctttgg

SEQ ID NO: 50847 - DNA, 824 bp, Homo sapiens
ctaaaaaggccttctttcagttccttcaccagctgcatttgctgggcacagtgccccagcaggtgcagctggtgaaggaactgaaagaaggcctttgtagcccagaaagcaaagtggagaatggtgggaaatgaagctaaaaaggtgaagagctgggcgcggtggctcacacctgtaatcacagcacttttggaggctgaggctggaagattgcttgagccaaggagttcaagatcagcctgggtaacacgagaccttgtctctatgcaaaatcaaaaaagtaagctgggtgtggtgactggaggtgctaacctaggaagaattggtgtgatcagcaacagagagaggcaccctggatctttcgacgtggttcacgtgaagagatgccaatggcaacagctttgccactgcgactttccaacatatcggacattggcaagggcaaacgaaccatggatgtctcttccccgaggaaacgggtatccgcctcaccattgcctgaagagagagaccaccagactggcggccaaaccagagcacgaggcgtgacaacgggtcccagggtgaccacggccgactcaagcacgcaactcacacacactggcccacgcataccacgcaacaaaacacaacacacgacaccgcaccgacaacaacacccccaggaggggccccctgctcacggtacacaaagacacgggagcaacgggccccctctacacaacccgcacaaaaacacaaggcccgcaccgacaaacagagaacacaacggagccaacagcacgcgacacgcgcgcacgagcaccccaatctgagagacaacc

SEQ ID NO: 50848 - DNA, 437 bp, Homo sapiens
aaaagatccgatggagactagaaggcttttctgaggatgaaaccctcgagctagaatctgaaggatgggtaaaagtttgctgggcacagtgccccagcaggtgcagctggtgaaggaactgaaagaaggcctttgtagcccagaaagcaaagtggagaatggtgggaaatgaagctaaaaaggtgaagagctgggcgcggtggctcacacctgtaatcacagcacttttggaggctgaggctggaagattgcttgagccaaggagttcaagatcagcctgggtaacacgagaccttgtctctatgcaaaatcaaaaaagtaagctgggtgtggtgacccatgccagtgatcccagctacttgggaggctgaggtggggggcttaaagctgcagtgagtcatgatggtgccactgcagtccatcctgggtgacagagt

SEQ ID NO: 50849 - DNA, 510 bp, Homo sapiens
ctcttagcacattcaatcaatgctaactattattatcacaggtaacatgtgaataacagaattgagctaccatttttcagccaacccccaaccctccgctcttctctcttctctaagtttaattgtaaaacacagttcatttaaaaaacaaacaaacaaacaaacaaacaaaaacaaaaaacttttgacaagcatatgtttttaattttcaaataatttcaactttttttattttagattcaggggctacatatgcacaggtttgttacatgggtgtattgtgggatgctgaggtttggggtgtgggatggtcccatcacccaagtagtgaggcatagtacccaacaggtaggctgtttcaacccttgccctcctcccggggacgctctagtgggtccccagtgtgtctattgttcctatgtttatgtccacgagcactcaatgtttagctcccacttataagtgaaaacatatttggttttctgttcttgcattagtttgtttaggaca

SEQ ID NO: 50850 - DNA, 474 bp, Homo sapiens
attgtggaacctctctggcccttggtctcttcccctgtaaaaggtggaggagggattagacaatctcaatggttaagaatttatcatccatgcacactaaatctaataagagttttataatatactttaaaaatcatttttatataatggaataagaacatagtcattgtaggaaactcaaaaaaaaatgcaaagaatatagaagaaaataaatgtcaattaaaatttttccacccagaagtaactgttgcttatcttcagcagtttgagtgaatgtattttgaatatattttggtgtgttttcttctgatattttctgtgcatacctacttacaaatctgggaattatactatacatggctcaggagcctacttctcacctaacattataccagaggcaaatcttctcatcattaaatgttcttttaattgtctttgttaatgtctacataataccctattacattttatgcc

SEQ ID NO: 50851 - DNA, 529 bp, Homo sapiens
cagatcacttgagctcaggagtttgagaccagcctggacaacaaggcaaaaccctgtctctacaaaaaaatacaagaattaactgggcatggtggctcatatttatagtccaagctacttgggggactgaagtgggaggattggttgagcccaggaggttgaggctgcaatgagtggagatcatgccactgcactccagcccggatgacaaagtgagaccctgtatcaaaaacaaacaaacaaaaaaaccaaaaaaaaacaccatgtgtagctttgctaattaatggactagatatacaaatacaaactaatttcctgagtttagctgtttaggaaagaggcaataactaaacgaaggagacagtagagtcaagaaatggcatttaataatgtggcttcttgaacacagaagcaaagaccaaataagagagagaccggggtggtacctggagaatcaggagtggtgtggagagggtgaggtagaatttgtcattgccagcaataatgggaagttttagattgtttaaaa

SEQ ID NO: 50852 - DNA, 270 bp, Homo sapiens
gtataatcctatagattgaattgtatgaagctacagaaggcatgcttatcaaatatgtagatggcatgaagcctggcaagagaatgaacacattgtatgtcagaaccagaaatgaaataacaaaaaaaatcttgtcagtctgtagcaatgggatgaatctctaaaaagatagaagttaacagggattaacataagatcctacacttgggtccaaaaactcaactgcccaaatgcagttggaagtgatgtagtgtagcagcctgtgataaa

SEQ ID NO: 50853 - DNA, 488 bp, Homo sapiens
agctgagcccaagtcttgagacaccccattcctactgaggctgcctcttcactcagcactgctgctgtgcccctgtttggaaccctttctgcacttggcttttctaacagtgagctctactgagtcttctacttacgcctctaaccactgcttctgtgtttccttatcagccccagggccgatggcctgagagtagaagaaggagtaggctttgatagctgagcccccaaaggtaaatcaaatttaactttgttatgctaaggctataaaaaaaaatggacatgaagaagttgaagcagagcatgtagagtttgctgacagagttctcgaacaagcagttacagaggcaaaccacagtgaaacaacagaagaagggaacctggtggagatggctgctgagaagttgctccatgaactcagaggacctatagaagggcctacctacactcattgtcttagagcagccttgctaacccacgggcagcgag

SEQ ID NO: 50854 - DNA, 255 bp, Homo sapiens
gactagtgctcaaattgaaaattatatgttctcatgaacatataattttttttaaatggtcagccataggtcactgcgtctcatcttacgaatattccccatgcctcactcattggtcaggtgagtaattcccagacctgtgctttattgactgaattatattcactagtttattcagtagttttctctacttttccagaggagttgtcacatttagagatcaagctcaaagtttgctgccttgtgccttggctt

SEQ ID NO: 50855 - DNA, 382 bp, Homo sapiens
cacaactggtttggttaaagcaatcttctgaaaaaaattgtacaatggatgttagattgccagggttacactgccaaagtattttcacacagatgttaggttagagataactaagactgggaaaaaaatacatatttatcctttgcttgtttatcaaacactatgttaggagttctcaaacccagctaaacattagaattacatggagaactttttataaaagatatattggtgaagagacagctagaaatagacatttaaaagaaaaagcagggtcgggtgctgtggttccgtctgtaatcccagcactttggaagactgagtgggggaggatctcttggggccaagagttcaagaccagtctgatcaatatagcaagacc

SEQ ID NO: 50856 - DNA, 2096 bp, Homo sapiens
  misc_feature (51)..(51): n is a, c, g, or t
  misc_feature (134)..(134): n is a, c, g, or t
aaaacatgttgcttttatcagttaggatacagggtgaactgtaacaaaganacccctaaaacagtgactaaatcaagagaggaatctatttctttctcctgaaacaatttagaaaatagttatccattgactanaaattagcacatgcccacagctggctcccacggtagccaggagaattatctataggtggaaagtctgtgtcagccaaagccatgtcactctgagagaactgattctgaggacaagttagccatctaccacccatgtcccttatttggtcctcacaataacactttaggagagatatcattatcgctgttttataaataagggaaactttagcttgagggtttaaggaacataaccaaagttcacaaacataacaagtgagagaaacacattcaagcccaggtctagttgactttaatgaatctttggtgtggaatgaaaaatgtgaacttcttactcatagtgtggtttttaaatatatgcagttgagtgatgattggatactattcatcatattgcctataatatatatttaccgataagcagtgagtgtaaaattgttgtagcttgaataagaaaccacttttgtagttttaatcagactttctcttaaaaacattagataaaataaaagattcaccggatggattctgatgaaaacgaaaacaaagtaaaatgactggcttagcagattctttgaaatgtagcagcccagggatgtaccaaatgtcgaattctagactgaggagtagagttcattggagtcttaaactctctgatatcacttaaagctggagtttattttaaaacaaatgaagcatgggccacctcatgatgcagtggctcctctctggttgaggagagggaaaattggaaaaactggtcgagtaattatcaataattttttttaaaaagaggatcccaaactgtaaaagattgaaataatctttctcaggattttttaaatgtctaagattatgatgtcatatctcccacttacctgataagtaaaaaggttaatatcaagtaacttattagctcttaaagtaaaattgaacttattaaaagctatctatgatttaatagatttaataaaattccttcacgacctggtacccttgtgaaactgtaaaatatatcatatggggggagttttttaactcttattttttgaaaatttactgtagcttctatttcgtgaataagaatgttttgattttgatcatacaaataacttttgtagatttttgtttacttttggggggggttcccttagaagacattaaaaaaaaatactgccttggtctgtgcaggctgctgtaatgaaatactatgaacttggcagcttataaacaacagaaatttatttctcgctgttctcaatggtgggaagtccaagattaagggatcaacaaattaggcctctggatcatacatggcattttctagctgtgtccttatacataaaaggaaaaaggtagctctctcgagtctctttaataaagatactaattctcatgactgaatcaccctccaaaggccccacctcctaataccatcactctggggactaggtgtcagcatgtgaattttggaaaacacaaaaattcagaacatagcaaatgcctttgaagtataaaagataaaattcatttttagtgaaccctgtaatttattcgtgtatatttactaaacagctgtatctttgaaattgttagtaatgattctgcttcaataactatggtcagggaatttataatattatatttttatatactgaactgccatagatgctggaaaaaaggaactgatgttttcagcatattttcaaaatattgataagggaagttattacttttatatagtattcaacttttttcaggtaatagaagtgaataatttattgtgaaataattcattttataaatgtataattatttttataaattttattgttggaaatcaaaaattagtagattttttaccatgttaaattatagtgagattaaagtattactaaactgtgatgctatgtttgtttcactaaactttctaaataaaaactgagaaaaaaaaaatcactg

SEQ ID NO: 50857 - DNA, 3148 bp, Homo sapiens
agaaaattaacttgattaatatgttttattcatttgtggacactaaaatagctcaggaaagtgaaaatgtcttagacatacgcaagtcacatgaccatttaaatgtgcaaatgtaagaagattcaatgtgtttacatcaaatgacatattttattgatttattgcagattcagtgcatatgagccaaattgttgagtgtgtaagagctatattgtgtattttattaaattaatatatagttgtgttgcaaaaatatttgggcttatattgtaaatggcaagtgttgccttggtagctgtcgaactctatgagttttgttttttcctgcttccttttccccatggagtgtgggaagcagtgcctcagagcaaagtctcttgtttaatgtatagtctaccaagtactacagtacataatctgttcaaaatgtgtttgagtgagctgatggagctaactgaaaggtcaaaaattacatccatcagtcatggttatgtgcaagtccttgtagaagcttttattaaagtcatgctaaatcacaagaattgacatttgtaccaatatctgaaacttcttcatgttttttcaataacatacagcttctgcctgtgtagatattatgccatcagttggttctcaaaagtattttaagtgcttcagatgtgtgttcccattatattttgaaaacatgaaaaatgctttaatgcatgtatgtaccagcagtggttacttgcattgtgtagtgtttttcaagaggtctgggtcttaacaaaatgttttcctttatctcagtgctcttctgcctctttttgttggtgtcctttgagaacaatacaccttctattccttcatttggttacacctttccttgtgacatttagcgagtttcaaacttacttccatatgaggctaagaaacctcaaatttcaggaattgggaaaaataaaattagcacttgcagaagtagcagcagatgggaaaatgccttgattgacattttctttcagcatttaaaatttttggcattttacagcttcatgacaaacagttttgtgcccataccttagaaaatgtggtgctgagttaaataaaggctgtttgagcactggagcagaaaaatgcattatttgcaaactggtggataattttgtgccttctcttctggccaccaagccagtgtagaaacagcaaaaatgtcataaaaattcttatatttaaaacaaaaacaaaagcaaaaacaaacattgaattaaattaagttttgtaattttaaactttaaaaacttctactgaaaatatttccgccaaatgccatcaatattttagactgtacctcgtttgcaaaactgctttgagagggaagagtggacaactcccatcagccttattctcttgagaactatattttggttcctagtaacagcctttccaaagctctactcttggtttttattactcataaatgtttaaattagaaaagaagggaccttgtacatgtgaaacctaattgactctctatattttggacaatttatgtatctgaaatgtgttgtctctgttatatgatgttatttttgccaggagactacaggttgatttagcttgatagctgaaatttgatggaaaactgatttccatttagtcttaccaagtgttgcttctctcttactagacagatatccacttagtaaaatctaaagcagtatgtaaatgaaaccagcaaagagagtagggtttattttataaacattcttaatgctaagtaaccagttgttcaatttattatatgtgtctgaggacattaaaacaccataagattgtaataattggttgtgccaatgtgtgagggatttacctttaggctctctgtcaccagtgatttactagtgttagctgtttaacacattatctgtatttagtagtgattatttatttacaagttggtggtaattcagcagtcaggactctaagcttttatagttgaattgaggaaatctcgcttttattcatttagctggcaactgcctttattgcagacctctggtgcttggctttcaaggaagcctatgagatgccaaaatcacacctttagagagcaccttgctctaataggtgatgcatgagcaaacagtgagatttgaaggggttttaacataatttagaatgtgaaaaaaatatcaattcatatctttcaagtactaacccctcaaaaaagcccacacatacaaaatatgtgatgtgataccactttgtcttttaggtctttaagtaactgaagttaagcacagaaaaaaaaatcacttcatggaaatttcagtaagaaacccaaacttctaaaaattgcttgcagatgagctaaaaaaaaaaaaaaaaaaaaaaagcaacaaaataaccttttcatcagagttaaaagtagtgagaatctgttagttatacgtataccaaagtaaacattaaagagacatatcatgcaatttcaaagaattctttcatgctatttcttaacctgacatttctaactttattgcaggcaatatacaaagattggctcactactccataggttaattgaattcctggttgagaaactaacttgttttgttttccaaaattagctgaaatcttgtaaaacatgacttccctttaaaggatctagatattgttcaatttaaaatatggcaccataaaaaagtcatgtagtaatagagcatatgcttttttagaaccaggttaaaagctgtttgttatctaatagagtaaaagttactgaggtcaacagatagacaggtctggcataatatatgcccagtcataatagtctaattatattcttttgacaacagacagcattcatcagagcactaattcgaatgagagttttggctatcaagatgtgttgattctaaatattattgaatgagacctgattaaagtctgactttcctggccccagtgttttgcaggttggctatttccattatcagcccatcactccataaagttcttagctgcaccaagtgattggtgaacaaggacaacaacaaaagcagcatacattgtatggatttatctcaacgctattgtttaatggctgtgtttaatgtgatctatctggaaaatgaggactccgaataaaaagctattactaata

SEQ ID NO: 50858 - DNA, 1338 bp, Homo sapiens
agcccggcctcctgtgggttcggcgaccatcgcgcggcggccatgggggcgcggctgggccggcgggccgggcccgaggctggctctgaggccggggcggcggccggctgcgggcccgcgccctacgagcgccgggtgcggtggctccgcgagatccagtccacgctccgcgagcggcggccggagcgcgcccggcagctgctgcgcctcctgcgccaggacctgggccttgagaggaccctccttcctgatatcctctacagagatgtggccttcctcaacccggtcgaccccatctcccatgacctgcttgtgaacctggcccgggacctgcagtgccccaagaaggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcaaaaaacaatactatcaccatctatttcgtcatcttgctcacatactacaaatctcatatgaacaactatacagaacatcagacgatactgtacact

SEQ ID NO: 50859 - DNA, 1279 bp, Homo sapiens
ccctgggcccgaggacagggaacaagggctcattgtctgggcttcctcccgccgggcactgcgggactggaccagcctgtccagctcccagagggcagcctcccctggctctgtgccaggccacagccgggttggggggtaggagggggaggccctggtgggcaactcggtgatgcatggtgcatgactgtgctcacacacacacttggctgcctgggtccctctccccaaggccctgaggtgggcaggaggggctcagattcaccatggtgacactgccctcccacaggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcaaaaaacaatactatcaccatctatttcgtcatcttgctcacatactacaaatctcatatgaacaactatacagaacatcagacgatactgtacact

SEQ ID NO: 50860 - DNA, 319 bp, Homo sapiens
cctggtgggcaactcggtgatgcatggtgcatgactgtgctcacacacacacttggctgcctgggtccctctccccaaggccctgaggtgggcaggaggggctcagattcaccatggtgacactgccctcccacaggactatgagctctggaagtcctcggacaagatctgccgacagctcatctaccacctcacccctcactcgaagcagcagcaagggtccagcctgcgccagaggaagacccagagctggtaagggtagcccagccactgcccctcctcactgctgctccaaggtcccttctcaggttgacacctg

SEQ ID NO: 50861 - DNA, 1775 bp, Homo sapiens
gtacacatccccagcatctgtgcatcacaacactcggtccggtggtggctctgctcctacacacaccaggacctgggccttgagaggaccctccttcctgatatcctctacagagatgtggccttcctcaacccggtcgaccccatctcccatgacctgcttgtgaacctggcccgggacctgcagtgccccaagaagctgcccagaaccccatgctgacagcacctgcagatgtcctgccatgagcatcgacacagccccaggatgtgtggctgtgaccagccaccggacccagactcctagtcacagtgagtccccaaccaaaaccagggtatccgctctgggccctgccagctctgaatgcccaggtctctgcacagtcggcccctaggactctgcgcctagcccacggccatcacaggaacagccagggcttgcagctgctgtgtgtgctgcctgctcctggggctgctcacagagggactggataaaggatgcagtggagcatgctcagtgccagctttgtgggccgcgcacctcggattccaccctgagctgggcctctgccggagcccagttaggactgagagagagccaggtggtggtgctgtaaaacattacatcccccagccctgtcagcccagacccagaccccgcaggcgcagtctcgcttggagagtgagaggaagaagaacacgctgacctggcttgttcctactccctgggattggcgtcagtggagcacggctccctcgaggggcctggtctggcctcctccccctgtggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcaaaaaacaatactatcaccatctatttcgtcatcttgctcacatactacaaatctcatatgaacaactatacagaacatcagacgatactgtacact

SEQ ID NO: 50862 - DNA, 1678 bp, Homo sapiens
gtacacatccccagcatctgtgcatcacaacactcggtccggtggtggctctgctcctacacacaccaggacctgggccttgagaggaccctccttcctgatatcctctacagagatgtggccttcctcaacccggtcgaccccatctcccatgacctgcttgtgaacctggcccgggacctgcagtgccccaagaagctgcccagaaccccatgctgacagcacctgcagatgtcctgccatgagcatcgacacagccccaggatgtgtggctgtgaccagccaccggacccagactcctagtcacagtgagtccccaaccaaaaccagggtatccgctctgggccctgccagctctgaatgcccaggtctctgcacagtcggcccctaggactctgcgcctagcccacggccatcacaggaacagccagggcttgcagctgctgtgtgtgctgcctgctcctggggctgctcacagagggactggataaaggatgcagtggagcatgctcagtgccagctttgtgggccgcgcacctcggattccaccctgagctgggcctctgccggagcccagttaggactgagagagagccaggtggtggtgctgtaaaacattacatcccccagccctgtcagcccagacccagaccccgcaggcgcagtctcgcttggagagtgagaggaagaagaacacgctgacctggcttgttcctactccctgggattggcgtcagtggagcacggctccctcgaggggcctggtctggcctcctccccctgtggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgc

SEQ ID NO: 50863 - DNA, 625 bp, Homo sapiens
tggggaggggaaggagcggcacatggggttgagcagaggagaaaatcagaaagatggcttagagaagccagcagtctgcaagtctggggaggatggagagtggtttggggtttggggtcggggtctaaggtgatcagatgcagaagcattacacggtggcctggtttctttactcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttggtaggaggataccccagagagcacctccaatcctgttctttctaaaaagaggaaacttccaataaccacacttttccaatgggaaagatacgcccccagtggctgagctctccacgcaggaggactcagaagtgatcactcatgagggacacttaggagacgatagaggactaggctagacttgatcaaggttggcgcttgggatgagaaagcttggtttcgggccagg

SEQ ID NO: 50864 - DNA, 349 bp, Homo sapiens
gactcaaacatgtctctgggctgtcagttctgtcacttctgtcacttctgtgtcactgtactagggaaccgtacacatgggaagatttcaagggcgccaccatgagagcaatattcccttccttgccaaaactcttgtcttcttggcctgaaattctaccacctggcactttagcttaaggctctgattgtggttaaactacatctctcttgggaatgagaaccctttcagctatgatcagtccctcataccttcctgtgaatgagctctagatgcttagctaagagaagatcttgacggggaggctggggagtttgagggaagtagggagagaaggttggaaagagaa

SEQ ID NO: 50865 - DNA, 456 bp, Homo sapiens
tagaaaaagactgatgatatatatccgtagtatgcgctaccaaagcaaatggcagggacgactaagacccaaccttcatcaccaaagacaagtgtgaatgacacgctggttcacctaggcaaggcggattcagattcctcagcatgcggagttcctggaaattgataaaaatgggcacagcacagaaaatgggcagttcacaaaagtggtgcaggtgacccatgagaagttcacatcaccaatggttacagaaatgaaaatcattcaccagccacttgcccccaccagggctggctgcgtgaccttgggcagtgtctatgatcatctgttatgcagcaatacaaaacaaataccctctctcttttagtctgtatttttttctgaatattttgcagtggtttttcgttgttgctgtttttacatttaagctgtgaagtggcagacacaacacaaacc

SEQ ID NO: 50866 - DNA, 972 bp, Homo sapiens
aaaatgcaaagtgaaattgatcgagtcatgtaagattttgtgtccaaactccactgggctgtggataattttaccctcaaggtcctccacactgtagtatggacacccaggtgtgtcccatagaggacataacaaaaatgtatcttaactgggaaaaaaagattaacaaaaagaatgaagatgtgcctcagctgcatgaatatagaaggagaaagatccctctatgtcattccctgggtgatagcaggagaacattatcctaagtaggaaaaaaagacagtggaaacctggttgaaggagcttttttgcacatcaccctggggagccacaaaagagagacaggaacaaaagaacagctgcaaagggagtgaaagaaacccaaagaggcattggcacaggcctactgggaatatgatatggcaaagagagaaaatgaggtctgttttctagttagagaagattgatctattcaaaggactttaaattttgttgattcactttgggtgcatccatgtgaaggtttgagttttgaatcatcatgatttttagccagtaaaagtgttctgggttttagcttcacccacatggacctcaactcgctatttagaagtctactgcccttcaggtgggttgccaacagactctgcctttgctgtacctgggagaatggcttcctcatcaccacattctgcatccttccaagatggcagtgaagatcttcccagggcatctggcattagcagaatgcggctgatgaggaaatatgaccccagtttaggccgttttaccagaatattacacaaattacaaaataacttgatagctagaagagaggattttgaatgtttttactacaaagaaatgattaatgtttgaggtggtggatttgttaattaccctgatttgatccttgtacaatgtatatcaaacatctcattgtacaccagaaatatgtataattttgtgtcaatt

SEQ ID NO: 50867 - DNA, 380 bp, Homo sapiens
gtgattctggcctcctaaagtgctgggattagaggtgtgagctactgcgcccagcctgtcatttaatcttcatggaaactaccatagcttttctgattcttcgttctagtctggctggttgataatatatttaatggaatcattaaaagtttagggttgaaaatttgtggtaaatttgtgaattctttaaattgagcattttgaagtattttctccccacagggattctgaaaacatattagattatacacacacagaagcaaagacagctgaaccttgaggccatttgaaaatcctggcactgtgccagaaagagagctgggctgctgctcttgcaaagaaacagaacacctttcctcttgcttttgttgactgtaatg

SEQ ID NO: 50868 - DNA, 187 bp, Homo sapiens
agaaaaggcccagaagacaagcttttaggaagcagatgcagcccttctccagggggaagttgggggtgggaatatggcagagatgtctgagatgaccgtttgagaaagaaggcactggagtgggcagtgaggactggaacatggtgtggaaggtcctcccacctccctgtctcgacttaattttttt

SEQ ID NO: 50869 - DNA, 322 bp, Homo sapiens
aggcatggactggagccccaaaggcagggtacacgcttctcctgaacctgcttcttgtttcctctatatggctccatttgtggcaaagttgttgcactgaaacttgtgcatgccgggcaaggacaagctggctcaaagagcaaccagccacctctgcaaaggtgtagcaggagccggtgtaccagtcaccaattagcgtcctaccctaaaggtagggccacagtgccatctgcttttcttaaggcctctgctccatcagcaataaggtggcagacactcaggctgtgggaacctggccatccccacttcctcgagcgggtga

SEQ ID NO: 50870 - DNA, 359 bp, Homo sapiens
gttctccaattactgagaaatataatggctaggaatcacatgaggactttataaaaaagcagcctcctggagcttcctcccactcagagtaactgaggaatctgtcccagagacccccaccaccaaccacacattggagaacaggggccaacagggcaaagtacagactttccagcaggccctagaaggcccccaggatctgggctctgtccagctctctaccatcccctgttctcccctcacatcctaagcattaactgcatgccagtgtcgggccacagggatgggtacagaggcatgtcaggcaaagcagcctgtagtcacagactatgtgggcatagaattgcaggagcacattt

SEQ ID NO: 50871 - DNA, 601 bp, Homo sapiens
tagaccaagtttgattaggcaacttgtttgttccacttttgttcaacccagcagttttaaaagaatgcagagtcttagttcaaaatggttccctttgcttgaaaaatcttaaaaacattggagtgcagttcaggatttaccaaattaaggttcagcttaaagctgatggtgcttctgttggtgtttgttcagaatctgtatttttagtcactttttaaaaaattacttggctcctgtttgtggacccttgtaagccaactgagttacccagatgctaactacatattcacatatggctataacctcctgagagtgtcaggtccataagtctgtgttctctgtatgaaacaaaggacctatggggaaagtggaacctgtaattccagagaaaaggagctttcttcacaaatgttgctttttagtggctcctatcccagaatcaatggaaagaaaattggaccttttaggtattcatgctgacaggtggtctcataacaaatttctcagctatccaaaggatgaaaaactgtaggtatctatcatttttaaaaaaaacaagatgaggaagctcttcatataccaatacagaattttcctaaga

SEQ ID NO: 50872 - DNA, 162 bp, Homo sapiens
tataaggtttgaggtatataggttgagattaatttctttgtatatgggtatctagttgttccaacagtgtatgttgaaaagactatcctttctctattgaattgcctttgaaactttgctcaaaacaactgcccattatttgtgggggtctatttttttcat

SEQ ID NO: 50873 - DNA, 336 bp, Homo sapiens
aactttttggtgatagggtttctgtgctgagccctaagcccatgccccactctacatatgctgccttttgataatgcaatccaaatcactcaattcaaaacaattgttttccttgctcttatataacagataaacttggtggttgctagaaactacataaaattccaaaaataagggggccaggttttattcctgtgttgcctggaatatcttcagatcaaacaagagcaaaaagggcctttgagacaggtgtggtctgtgtgcaagatgctcatatcttcctctgtagtccgcaaacttttgtttttagcagtacaactccttttgcaaatgaaa

SEQ ID NO: 50874 - DNA, 1321 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50875 - DNA, 1323 bp, Homo sapiens
cttgtggcccaattcaagcttgattcaggaattcggcacgacccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50876 - DNA, 1776 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaaaaaaaaacaaaaaaaaaaaaaaaaaaaaaaacagaacaacaaaacaaaaaaaaaaacaaggggggggcggcgggcaaaagaaagacaccccagggggggcgccaaaaagtaggtgggcgcccccgcggttgttcttgtgagaacacaaggaggggcacccaaaaggagaggcaccaaatcaaaaaagacagaaagacacggggacgccaaataaaaaaccacggcagacagaagcggaaaaaaaacagacacacgagaagaccaaggaggagaggaaacaaccaaacacggagagagggagcacaccaaaatgagaagcaaacaacaacacacaacaaaaaaaaacgcccaaggacaacataaaacacaaaacagaaaagcaacgggaaacaaaaaaccaaagcacccgcataagaaaatatacaaaaagacaaggacgaagaacaaaatacacg

SEQ ID NO: 50877 - DNA, 1735 bp, Homo sapiens
  misc_feature (1502)..(1502): n is a, c, g, or t
  misc_feature (1620)..(1620): n is a, c, g, or t
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaaaaaaaaacaaaaaaaaaaaaaaaaaaaaaaagtgtgtgtgtgggcgcggcctgtgggcctgtggagaaaagttttttcaaacaccatttggttgtggggcgcgcgggggccccgttggtgtatgggagcacagggcgcaacacaaagcacgggtggcccacaaggagagaacccggggtcngagaacacagagtgcgcgggggggcatctttgccaacccgacataaaaaaaaaaaaggcccgggggggggaacacaccgagcgaggcgtgcggggaaacaaactctctcccagaggcngggcgcctagcgggaggaggcaacacataacgggggcaccattcaatacacaggggggggtcccacaagggaaggcctccgcattcacaaaattaagccccgcgcgcgggggggt

SEQ ID NO: 50878 - DNA, 1356 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaacctaattactacatttgaccacgatctgtgctcta

SEQ ID NO: 50879 - DNA, 1360 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaaaaaaaaaaagtcgacgcggccgcgaatttagtagtagta

SEQ ID NO: 50880 - DNA, 1329 bp, Homo sapiens
  misc_feature (1288)..(1288): n is a, c, g, or t
  misc_feature (1291)..(1291): n is a, c, g, or t
  misc_feature (1297)..(1297): n is a, c, g, or t
  misc_feature (1310)..(1310): n is a, c, g, or t
  misc_feature (1313)..(1313): n is a, c, g, or t
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaacanaantacacnggccccagggtanatncttcaaatgactcact

SEQ ID NO: 50881 - DNA, 1133 bp, Homo sapiens
  misc_feature (21)..(21): n is a, c, g, or t
taccggtccggaattcccggngatatggccgcccccgtggatctagagctgaagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50882 - DNA, 1384 bp, Homo sapiens
ggtgaaaagtaccatttgcttgctgttcctatgtaaaaatattaaggtagcagcagtctgaactgttaactttgtcactgaggaattgtgtgctgtaactgacttaattagctgaatttctctgaaaacagtcaattttaagccataccaagaattttctgattttagctgccacttatctcatagtgcaaagttaggaataacttactatctaatctgagagagaggactgaaatgttcatgtcaaggaacataatctgcttaatgaaatatccaagaaggagctcagaaaaatattgacttagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50883 - DNA, 1156 bp, Homo sapiens
cttgtggcccaattcaagcttgattcaggaattcggcacgacccaagatggccgcccccgtggatctagagctgaagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50884 - DNA, 1119 bp, Homo sapiens
caggcagggaaggcgaggcgatatagagacgaacgaggttcaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50885 - DNA, 1129 bp, Homo sapiens
gtgtattgattatttgcgtagaacctgcaggagacgacaggcgaagagctcaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50886 - DNA, 1275 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtcagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50887 - DNA, 1343 bp, Homo sapiens
tcgcaggcgcctgagagaatggagcgagagtggtgcgtacccgtgcgaattacagggtcactactgcgctcactgcatcatgaacgcgcagaagctaattgacctgtactcccgaacgcgtatagctcgcagacatacagattgaacagctaaacagaacgaaaaagcatgcacatcttacagatacagagatcatgactttggtagatgagactaacatgtatgaaggtgtaggaagaatttcattcttcgagctccgaaggcaagccaattcaccaggtcgagcgtgttcagcagcacagccagcaaacatcagccagcaagcaaaacacattaaagacactagaacagccagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50888 - DNA, 1269 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaagggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50889 - DNA, 1261 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50890 - DNA, 1203 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50891 - DNA, 1115 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaaatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50892 - DNA, 1051 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50893 - DNA, 1086 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaacctaattactacatttgaccacgatctgtgctcta

SEQ ID NO: 50894 - DNA, 549 bp, Homo sapiens
cttgtggcccaattcaagcttgattcaggaattcggcacgacccaagatggccgcccccgtggatctagagctgaagaaggccttcacagagcttcaagccaaagttattgacactcaacagaaggtgaagctcgcagacatacagattgaacagctaaacatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaa

SEQ ID NO: 50895 - DNA, 1383 bp, Homo sapiens
atttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaagtaagtttttattggcaataggagttaacttttgggagaaagtagtaatcttattgtgtcatattaaatgaaaatgtatgcctgcctgccaaagtaatgtcatattatttttattttctataattacgttggagccgtgaagctgtcatattcatattcatagcgcatataagaccaaaacaaaaaaaaaaagaatagtctcttctttggaactgcagagaattttgatgagatggttttaacctgaatgtattttgtccattggcccttgaatgtgtttatcctttaaaaaaaacaaaaccataaacaaaatgtaatgtatatttaaacaacacttgtgtagtggattgtggtggatgggcaggagagtgggtaataatgataaattttagaggatcttggtatagggtcttttttacacattgtaatttctttaacctaaattaggttctatataaggacaaagtagcaagctataaccaattaactatctgaaggatggtgctccaatgagaacaattttttctttttagctagggaaaaagatgataggtaacagtaagcaaatctttggaaatattactttattatttttattattataatttatttatacattaagacctttagtgagatattcttcttgggctttggtgaaaggcccatcctgtgtatagtaaaagttagactggacaaaaagctggttatttcttagggaccaagatttcccaacatgtgggtggatacattgacttcataggtcatttcatctaatttctgtaagtactatttgaggcagaggatcagaatctaactcagccctctgctgaatttgggagctacaacttgtagcctcctgaggatttcttaggggcactgaattggcctggcctgggagtatgcagtatcttaggttacttaggcttatttttaactactgatagttgaaacaaacttgataatagatttgcagcttagaaaagtgtattgtaaaaaaaaaaaatccaaataattatctatttttaatcttccttctttttatatatctcatta

SEQ ID NO: 50896 - DNA, 475 bp, Homo sapiens
aaatattactttattatttttattattataatttatttatacattaagacctttagtgagatattcttcttgggctttggtgaaaggcccatcctgtgtatagtaaaagttagactggacaaaaagctggttatttcttagggaccaagatttcccaacatgtgggtggatacattgacttcataggtcatttcatctaatttctgtaagtactatttgaggcagaggatcagaatctaactcagccctctgctgaatttgggagctacaacttgtagcctcctgaggatttcttaggggcactgaattggcctggcctgggagtatgcagtatcttaggttacttaggcttatttttaactactgatagttgaaacaaacttgataatagatttgcagcttagaaaagtgtattgtaaaaacaagacaaaaaagcaaaaaaaccaagtaaagaaaaaacagcctgtgataacca

SEQ ID NO: 50897 - DNA, 388 bp, Homo sapiens
ctgcctgattcctatattaaataagaaagcagaatctacttttaagcctttattccttctcagccaagaaggtttaaacttctggtggtttcctgagcttgacgtattatgttaatatgcatttgtccttttaatttgctcagtttaatatttgtagtatgtagctattgatttcgatgaattcaatagtcatgtggcttaattttcaactttcttgtgtttcataggtttattcttcagtccaaggaagcaattcacagtcagctgttagagaagcagaaaatagcagaagaaaaaattaaagaactagaagtaagtttttattggcaataggagttaacttttgggagaaagtagtaatcttattgtgtcatattaaatgaaaatg

SEQ ID NO: 50898 - DNA, 664 bp, Homo sapiens
gaatgtctttgggaagcttttggaagtaataagttcgttttggaaagaacactccagacaagctttccaatagtctttcccaaactgtcatgcctgaggttctggacttactcttactcatccctgagagcacagcgactagctgaaggactgatcgactgatgagggtttgacctcatctacatacatctcaatttagcagcacatattaagctagctggcaaactgcttaaagccacatgggaaatctgcgcgttgggctatgtctggaagatacggaggagcaagccagacctgaccggtcaggtagtgaagacacggaatccgaaacccaaatatttcaggagtcaattctcagagaaagataagaagcccggttagtccaactcatgcgcaggcgcagaagaaagaccggcgcacaaagtaagacgcgcccttccccaccctatttcagtccaactcccactgcgcaggcgcttacagtgcaccaagatggccgcccccgtggatctagagctgaagaaggtaaaagagggtctttggcaggcggaggtcttctttttggaggctgaggggactatagacaagaatatcaagtgaggcacgagccttgcagaaggaaggagggtccagtggactagggaatggtttcccagagtcctaa

SEQ ID NO: 50899 - DNA, 390 bp, Homo sapiens
tccccccattaggaaagatacttacatgttttattcaaaattcttttaagccaccaccaaagaagagaaagaaattaacataataactctccgggtggttccctgtttacaaagtaagtttaacttttactttgttttccttcagagccctaaattcaactcctactttattccatatttccattttcagtcatccttgatgcctgaaatgatttagttgatgccatattgatttcgttcttgtttgcttcctcaaaatgtttctcatttttctgtccccttggctcatttctaagtgtgttttctaatgtccatatcctgcacaattgccagcagcaccatgacctagggaggaccctcattatgaactgcattctacaggaaaaaaga

SEQ ID NO: 50900 - DNA, 426 bp, Homo sapiens
tttccaaatcttgactatcgtgaacattgctgcaaaaaatatgggagtgcagatacctctttgatataccgttttcctttcttttgggtatatacccaacagtgggattgctggataatatggtagctctattttttgtgttttttttagaatcctccaaactattctccatagtggttgtactaatttacattcccaccaacagtgtataaacatttccttttctccacagtgtttgagggttcccttttctccactcctcaccagcatttgttattgcctgtcatttagataaaagccaaaaatatttttttttaattagccaggtgtggtagaggctgtggtgggaggatcacttgaacccagcagttcaaggctgtagtaagccatgattgcaccactgaactctagcctgagtgacagagg

SEQ ID NO: 50901 - DNA, 410 bp, Homo sapiens
tcccctcaactctgctgaactcagcacttccaagcagtcagaatggcagctgtaccctgcaccatgacataataaaggaaatggagccatggttctgtgtgtctcctggtgccagcatactgggctatcccagtctgatgccactatgccagcctctcccacagaactttaattccataagatgctctataaaaatgaatgaaggaatagaaaaacatttccagagtcaagtgactttgggatatattgcctataataattacaaaataacagtagtaatcacagttgataattactgagcatttactttgtgctgggcacataattatatttgactcttacaactctcctatgagataggtactattagccacaggaatgatattcaaaatatttaatgactagtacag

SEQ ID NO: 50902 - DNA, 1043 bp, Homo sapiens
ttttactctttaataaactttaattttcacattcttctaattttatgctaaatgtcttttacagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgagggtgagttgctcaacaatgtaaaatttaccctatctgaatctgcagtttattagttcagtcatgctaacaaaactgtatcatttcagctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggtaaatagttttatcaaatagtccaccccaaaatcattttttttgcctttagttttatatttcttctttaaagtgcttcaattaataagttcttt

SEQ ID NO: 50903 - DNA, 1322 bp, Homo sapiens
ggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggtaaatagttttatcaaatagtccaccccaaaatcattttttttgcctttagttttatatttcttctttaaagtgcttcaattaataagttcttt

SEQ ID NO: 50904 - DNA, 583 bp, Homo sapiens
gctgaggcaggagaatggcgtgaacccgggaggcggagcttgcagtgagcagagatcgcgccactgcactccagcctgggcaaaagagcgagactctgtctcaaaaaaaaaaaaaaaaagaaagaaagtttgaaattgttttaaaacagttaaggccaggtgctgtggctcattcctgtaatcccagaactttgggaggccaaggagagcagattgcttgagttcaggatttgagaccagcctgggcaacttgttcaaaccctgtctcttcaaacaattagctggatgtggtagcacttgtagtaccaactacttgggggctgaggcaggaggattgtttgagcccaggaaatcaaggctgtagtgagtcaagatgacaccactgcattccagcctgagcaacagcatgagaccttatctcaaggaaaaaaaaaaaaaaactagtcaagaggctagccacagtggctcatacctgtaatcctggcacttgggccaacacaagaagatcgcctgaggccacgagttcaaggctatggtgagctgtggttgtgcgactgagtaagagagcaagaccctggctctt

SEQ ID NO: 50905 - DNA, 504 bp, Homo sapiens
gctgaggcaggagaatggcgtgaacccgggaggcggagcttgcagtgagcagagatcgcgccactgcactccagcctgggcaaaagagcgagactctgtctcaaaaaaaaaaaaaaaaagaaagaaagtttgaaattgttttaaaacagttaaggccaggtgctgtggctcattcctgtaatcccagaactttgggaggccaaggagagcagattgcttgagttcaggatttgagaccagcctgggcaacttgttcaaaccctgtctcttcaaacaattagctggatgtggtagcacttgtagtaccaactacttgggggctgaggcaggaggattgtttgagcccaggaaatcaaggctgtagtgagtcaagatgacaccactgcattccagcctgagcaacagcatgagaccttatctcagaactttggggaggccaaggagagcagattgctttgagttcaggattttgagaccagcctggggcaacttgtttcaaaccct

SEQ ID NO: 50906 - DNA, 368 bp, Homo sapiens
ggagatcatccaagcaacttcagaattttagggtttcaaatttattgagaccctgagatgtgtggaaagaagatttgaatgattgtttcaaagtcatttattctataaaatcttttcttttttttttctttttaaaaattttactactttgcttttggagcagatatgaagtctgttatagctcttgaaaaagtatgcagtaatggtgttttaatagtgagaattacatttcttcctttcttcctaggatcgcttgagtccaagagtttgaagctgcagtgagctaggatggcgccactgcactttagactggacaatagagtgagaccctgtctctaaaaataaataaataaataaataaataaatg

SEQ ID NO: 50907 - DNA, 478 bp, Homo sapiens
caactcattactcttcacggtcctgagtttgcttttctgtaaaattgagaaagaaataattgcctgacctctcatcccacgattgtttttaagagtgggaatcacagcttggggggcagggagttgagagcttctgctgtagtggtgtgagcaacacaggatggccatatttaaattgggattgtactgtggagagttatattaaattcataaggtcaggagaaacagaaacacgggagttgggccttattgcagactcctcctcggtgattttatttggagtaaacggcacacgtaatcttagcatgtctcatgtcaaaatcacttcaaagaatgccacgggtgagtctgcggcagatgttcagggcatctttttaaaggagaaccaaaaaattaaaatttatttcctttttaattgtggctgttttaaactttgttactttaaaaattacatatgtgtaagtggtccactcttttt

SEQ ID NO: 50908 - DNA, 207 bp, Homo sapiens
tgtttcacatataacttgcacattaagtgaaaaaaaatgattatgctttagcttcttatctttgttaaaatgtagagctgtctggactctcaagatttcctcaaagggacctggaagaatagaaacagatttgacagattattgagatcctttgattacatatctagaatgcctgttacatatgtatttagttaactagttgtatta

SEQ ID NO: 50909 - DNA, 135 bp, Homo sapiens
acaagccatgtcttgcaataaatatagcaaatgcagggaaccagaaaagtcattcttctgtggtcatttgtaatctacttataagaaggaaggaagaatgggggtagggcggagttgtagcattcagcagaattg

SEQ ID NO: 50910 - DNA, 443 bp, Homo sapiens
tctttgacctaacattttccactgggccatatcccacaaccccaggagttcttcattcatttgctgtaagcaacctagacagactagatacaccccgtaaaaaggatgccacagaaaagggtctcattacctttctgctagtaaataccttcaggaggcctgattagtatgtttccaaggattctttactgggtcatttctctctctctcttcctctcccttctcttcttggacgtcctcagagaagacacgatgggttactaaataagcccaaaccctttccttctcaagaaccatttctatagcaaatgttattacattatgaccttttttaaaaatgtgtgtgcccctctccatatgatgatttatcatttgtaacacactcagagtgcacaaaccatcagaaatccttatctactatggtaaaatttgagcttcacggg

SEQ ID NO: 50911 - DNA, 205 bp, Homo sapiens
tgaagtaaaaagcccatggttgagtaaagatctcactatcaattgagaatgcattatggcaacatagtgtgatgacactcaaatgcacttaaacccagaaaacttgtataaagtttctcaagcaaagaaactaaaaaacagagaaagctcatcctcttgggcatataatagctgtaactgacatcactgttgttattagtgccac

SEQ ID NO: 50912 - DNA, 348 bp, Homo sapiens
aaagattcaaataaaatattaagaaactttctaaatggttctgacagtaatggtccagccagggaaataaagtttctagcctctttcttggggctttcagaatagactagataaccttagaattaaatgtggatttatgtttttctgaacagtacccccttttattgactacatgtttccccaagaatttgttttagagtagatgtttcaaataaagggtccaattcttaacccattcacattgtctcattttgcagataaccacttgcctagcataaaaatctttacgttgttctcagaaattgattcttgactctacacagcaaatccttcgtctttattgctgtg

SEQ ID NO: 50913 - DNA, 841 bp, Homo sapiens
tttagagggtctcaaggctgtggttgacatttttagtttgttgggctaaacaaccatttgctatacaatactatggaaacgaatggtggaagagattgccctggaaaactctgttcaattccgttaagaaatattaaattcctgaggacaatctacttgtttattattttcaatttctcttaaaatagtataaaaggatcttcttgggtggcagtacagggatgacaaggaagggaccaaatctcagttgttcacatttttacttagtttggattccaaataatggggcttctcataaaagatttggaccctgccccgaggcttttggtaataaatgtggccgctttgtttttttccctaattatttcattcgtaaaagtcttatcttcccaataaagatggtaactcctctggactgggtctgcttttcgcattttccttcttttatataccaccatggtatagaacttatttttgcttaataaacagtttggacatcaggaagagacagagctgtatacaataggtagtttacagtcaaatatttactgctttaaataaggcagaattggctgggcacagtggctcacgcctgtaatcccagcactttgggaggccgaggcgggcggatcacaaggtcaggagatcgagaccatcctggctaacctggtgaaaccccgtctctactaaaaatacaaaaaattagccgggcgtcgtggtgggcgcctatagtcccagctactcgggaggctgaggcaggagaatggcgtgaacccgggaggtggagcttgcagtgagccgagatcaagccactgcactccagcctgggtgacagagtgag

SEQ ID NO: 50914 - DNA, 754 bp, Homo sapiens
agaagttctgggggtacagcccaggtgtaggttctctgggagagtctgtcatgcactaaaatttgagagtcatgccataaaacctctttatagtgctccagtataaaaaagatcttggggttaagcttagctaaacaaatacgtctgcaggctggcagttcatgaattccacctaaagactatctggtttatccctcattttacacaaaaggaaactgtggtttagagggttgaagtaacatgttaaaattctcatggcttttttgtggtagagcagacactagaatcagttctccttcctccggtccatagctggctgcttctaatcttttaaaaatcagctaatcaaggtaacttggatccatttcaatcctgtcagtgaccctacgttcaatataaaagatgagtcctgggagaactgccgttctgattcacattcatctgaatgttgagcgagaaaggtttccatctcaaccacaccatgtgtgcatgtgcatgcacatacacgcgtgcgcgcgcacacacacacaccactgccaccaccacatagctcagatctgtcacaacatgagggaggggactcgcaaacatgcataatttatgcaggattttcacggatttttcagtatttggaagtgatttcttaaattatacattgaaacagctccataaagatgaagctggagttagtttcacaatagccttaaaagtgagagaatttgcgtctctgggatcaatgtgcatatttcaaagt

SEQ ID NO: 50915 - DNA, 669 bp, Homo sapiens
cctgggagaactgccgttctgattcacattcatctgaatgttgaaaaagtgcatttcttcagagtgctctgtaggaggtggaaatattcaataagcttgcgagaaaggtttccatctcaaccacaccatgtgtgcatgtgcatgcacatacacgcgtgcgcgcgcacacacacacaccactgccaccaccacatagctcagatctgtcacaacatgagggaggggactcgcaaacatgcataatttatgcaggattttcacggatttttcagtatttggaagtgatttcttaaattatacattgaaacagctccataaagatgaagctggagttagtttcacaatagccttaaaagtgagagaatttgcgtctctgggatcaatgtgcatatttcaaagtgagacgtttcactttatagaatttagagggtctcaaggctgtggttgacatttttagtttgttgggctaaacaaccatttgctatacaatactatggaaacgaatggtggaagagattgccctggaaaactctgttcaattccgttaagaaatattaaattcctgaggacaatctacttgtttattattttcaatttctcttaaaatagtataaaaggatcttcttgggtggcagtacagggatgacaaggaagggaccaaatctcagt

SEQ ID NO: 50916 - DNA, 269 bp, Homo sapiens
gcctcattcatcttaccctagtctatgcctgatctttccccaggtttctaatgttccattcctagagtcacacctcttactgcatcatcccttactgctttggcaggaagctgctgatacaccattttccttattcagaatctctcttcctcaccaaaatgttcagataagctttcagtagtttaacccacaacttaagcaaagttccttttcttctcttaagctatcagggctggtactatttactggatagaagtgtctttcggtct

SEQ ID NO: 50917 - DNA, 374 bp, Homo sapiens
ctggtcaataaatgtttatgtacaattcttatttctataggatgaatccctagaagtggaattgctgggtaaagtatataaacatttaaaaaactgttacatgttaccagatggtcctgccccaaaaaattgtattaatttttagtgtcaccaatttgataggtaaattttaacatattttgttttaataattggtcaggttaaatgttttttgtttattgataatttatatttaatcataatttttaaaaaatcatgtaatatatattccatattccaatttccttagttgtcccaaaaatatattcttgtaactttggtgaaatagcatctaatcaaagttcacatttagttattgtctccttaatctcttt

SEQ ID NO: 50918 - DNA, 2690 bp, Homo sapiens
  misc_feature (2575)..(2575): n is a, c, g, or t
  misc_feature (2590)..(2590): n is a, c, g, or t
  misc_feature (2597)..(2597): n is a, c, g, or t
  misc_feature (2608)..(2608): n is a, c, g, or t
gactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttgggtgncacatgtatctttgnaattggnttgattagtgngcttattcataaaaattcagtattttcattttacacacgaacgaacaacacacacagcaaatagaacaccaagaaaaaagaa

SEQ ID NO: 50919 - DNA, 2258 bp, Homo sapiens
  misc_feature (2143)..(2143): n is a, c, g, or t
  misc_feature (2158)..(2158): n is a, c, g, or t
  misc_feature (2165)..(2165): n is a, c, g, or t
  misc_feature (2176)..(2176): n is a, c, g, or t
gctcgctaccccttcatttgcaggattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttgggtgncacatgtatctttgnaattggnttgattagtgngcttattcataaaaattcagtattttcattttacacacgaacgaacaacacacacagcaaatagaacaccaagaaaaaagaa

SEQ ID NO: 50920 - DNA, 1998 bp, Homo sapiens
  misc_feature (1883)..(1883): n is a, c, g, or t
  misc_feature (1898)..(1898): n is a, c, g, or t
  misc_feature (1905)..(1905): n is a, c, g, or t
  misc_feature (1916)..(1916): n is a, c, g, or t
caccgagtccacaccacctgagtccacaccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttgggtgncacatgtatctttgnaattggnttgattagtgngcttattcataaaaattcagtattttcattttacacacgaacgaacaacacacacagcaaatagaacaccaagaaaaaagaa

SEQ ID NO: 50921 - DNA, 1788 bp, Homo sapiens
  misc_feature (13)..(13): n is a, c, g, or t
  misc_feature (20)..(20): n is a, c, g, or t
  misc_feature (23)..(23): n is a, c, g, or t
  misc_feature (27)..(27): n is a, c, g, or t
  misc_feature (33)..(33): n is a, c, g, or t
  misc_feature (43)..(43): n is a, c, g, or t
  misc_feature (45)..(45): n is a, c, g, or t
  misc_feature (1673)..(1673): n is a, c, g, or t
  misc_feature (1688)..(1688): n is a, c, g, or t
  misc_feature (1695)..(1695): n is a, c, g, or t
  misc_feature (1706)..(1706): n is a, c, g, or t
gtggtgaagtagngagggtnggntttngggtgngaaaggtgangnaagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttgggtgncacatgtatctttgnaattggnttgattagtgngcttattcataaaaattcagtattttcattttacacacgaacgaacaacacacacagcaaatagaacaccaagaaaaaagaa

SEQ ID NO: 50922 - DNA, 335 bp, Homo sapiens
aagcttccaacatcagtaatgcaaaattgtcttgaacctgcgataaaattttgttggacttttttttcattgcagtgaaaagggccatgtagcaggacggcaggcgattgcatctctatcgtaatccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgag

SEQ ID NO: 50923 - DNA, 298 bp, Homo sapiens
acaggctggagtgcaggggcgcaatcacgactcactgcagcctcgacctcctgggctcaagtgatcctcctgcctcacccacccaagtagctcggaccacagccacgtgcctccacaactggctaatttttgtatttttggagagatggggttttgccatgttgcccaggcttgtttaggaaaaaacattatgccacattctaaccggagcagaagtgcgcagacatctcagagtctaagctggcattaacaacttttacaaacccacctagctgattctgggcagtgtgcagggagg

SEQ ID NO: 50924 - DNA, 2069 bp, Homo sapiens
  misc_feature (1999)..(1999): n is a, c, g, or t
  misc_feature (2010)..(2010): n is a, c, g, or t
  misc_feature (2029)..(2030): n is a, c, g, or t
  misc_feature (2032)..(2032): n is a, c, g, or t
  misc_feature (2035)..(2035): n is a, c, g, or t
  misc_feature (2052)..(2053): n is a, c, g, or t
  misc_feature (2060)..(2060): n is a, c, g, or t
gagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctacaagtgtgggctgtgcatgcctttcttccaagaagtacagtacttccaagaagtgcagaagagttcggggagaagtaacttcacagtggagaaacctgacagccagcatggcctcacaaagattgattttactgctgctgaaaactgtctgaagatgagaagcagtttcagtaagaacaacagagagtaaacaaagctaagataacaacagtgaatgccacaaattctgaatagaacataacatggataaactgatttgttctacttcattaagttacactgaagttggagaagtttgcagaactttggcatacatagaggtcacaatagtatatgtttttatcaaactgaattctaattgttagaaggtaggacagtgaataatggcaatactgcagagtggttaggagaatgtgagctttgtggtcagtcagaaaactggttcaaatctcaaccgtgtcatttaggagttgggtgtgggcaagttatttaacttgagtcttacttctcacatctgtgtctgtcataggataattgtgtattatctgaatagtgagagttgaataaattatcctcaaaattaaataaaatggaaggattcagtatgatgcctggaaggcatgtatatattaaggtctcaataaatgctatttgttttgatttattattattacaataaaaaagtcacagtggaaaaagccaaattctcattttgatttaaaacttttccatattattattattatcatttaatgttttagagacaagatctccctctttcactcaggcttgggtgcagtcgtgaaatcatacatagcccactgcaacctcgaacgcctgaactcaagggatcccactgcttagctgggactaaaggtgtgtgccactgtgtttggctaactttttttattctttgtagagatgggggtcttgctgacatccaagatttatttcagtattttttagtaaattaatactattatgagcttaacagatgaaagttattcaccataaactttaaagaactgtgggaaaattatgtttaaacatttttatattatctcagctctgcttcatccacttccccagttattcatcagctttgaacacttcttctaaaagttaaatacttgtcagtcctcttaatggcctccaaggagagatatgtcaagaatttcatttgaagcctattttggtgtttaatcctgctgagcctatgtctctacaatttaacattcagtggaagcaataaatggtgatcatatcatcaagaaattggatccattcctcaaaaacattccagtgatccattcctttcatatccctgcgaaatgatttgtactcagaacagttgtgtgtttgcacaagcatatgcagcacattaagaatgccaaatctgaatttttcagtggtctgaagtggaaacttctcatagagcagccatatgttttctaggattgcattaatcttaccttttaggcaaacaatatagtgcattttgtctatgttttaccacatacaacaaatactgaaccctttcttattcctgtatctatgaatgaatatggaaagacttatctgaaaggcatatcaaggattttttttttttattagcttacttggccaggcgtggtggctcacttctgtaatcccagcactttgggaggcnaaggtgggtgnatcatgaggtcaggagttnnanacnagcctggccaacatggnnaaacccngtctctact

SEQ ID NO: 50925 - DNA, 959 bp, Homo sapiens
gagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaagcatgggagaaatggtctttcaaatccttttgcatccagactgacacggtacctcacgcctataatcccagcactttgagaggctgaggaggagttcgagaccagcctggccaacatggtgaaaccccgtctctactaaaaatacaaaaaattagctgggcagggtggcgggcgcctgtaatcccagctactcgggaggctcagggaggagaatcacttgaacccaggaggtggaggttgcagtgagccgagattgtgccactgcactccagcctgggcgacagtgcgggactccgtctcaaaccaaaccaaacctaaccaaagccaaagcaaaccaaaccaaaccaaaaaaaaaaaaaaaaaaaaaaaaaagagaaaaaagaaaaaaggagagaaagacgaagcagagcgagaacaaagaacagcgagacgagaaactaagcgcgcggcgcacacaaacggcggaacaacacagagcaagggcacacacagcgacccgcgcgacaccctctctcacagtgggggttacaaggggcggcccacaaagggggggcgtataaaactcaccgaaaagagcgatccgcaagagtagacacctgccgcaacacgggcacaacccaccacagagcaacacaaacgtgaacacaccaagacacacaacaagagaagcgaacagacaacaagagagacaaaa

SEQ ID NO: 50926 - DNA, 3537 bp, Homo sapiens
gagaggccttgtaggcacagcggctgagactcgatctgctccaagtaggggctccagcgcgggtcggagtctgggggttcgcgcccgccgacccgcgccctgctccctctcagcacctgggcggacggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcaagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgtttta

SEQ ID NO: 50927 - DNA, 2872 bp, Homo sapiens
gagaggccttgtaggcacagcggctgagactcgatctgctccaagtaggggctccagcgcgggtcggagtctgggggttcgcgcccgccgacccgcgccctgctccctctcagcacctgggcggacggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcaagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattcta

SEQ ID NO: 50928 - DNA, 1023 bp, Homo sapiens
gagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctacaagtgtgggctgtgcatgcctttcttccaagaagtacagtacttccaagaagtgcagaagagttcggggagaagtaacttcacagtggagaaacctgacagccagcatggcctcacaaagattgattttactgctgctgaaaactgtctgaagatgagaagcagtttcagtaagaacaacagagagtaaacaaagctaagataacaacagtgaatgccacaaattctgaatagaacataacatggataaactgatttgttctacttcattaagttacactgaagttggagaagtttgcagaactttggcatacatagaggtcacaatagtatatgtttttatcaaactgaattctaattgttagaaggtaggacagtgaataatggcaatactgcagagtggttaggagaatgtgagctttgtggtcagtcagaaaactggttcaaatctcaaccgtgtcatttaggagttgggtgtgggcaagttatttaacttgagtcttacttctcacatctgtgtctgtcataggataattgtgtattatctgaatagtgagagttgaataaattatcctcaaaattaaataaaatggaaggattcagtatgatgcctggaaggcatgtatatattaaggtctcaataaatgctatttgttttgatttattattattacaataaaaaagtcacagtgg

SEQ ID NO: 50929 - DNA, 1319 bp, Homo sapiens
gagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgtttta

SEQ ID NO: 50930 - DNA, 1051 bp, Homo sapiens
gagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctacaagggtgaaacacaactccctaatccttaagtgtgggctgtgcatgcctttcttccaagaagtacagtacttccaagaagtgcagaagagttcggggagaagtaacttcacagtggagaaacctgacagccagcatggcctcacaaagattgattttactgctgctgaaaactgtctgaagatgagaagcagtttcagtaagaacaacagagagtaaacaaagctaagataacaacagtgaatgccacaaattctgaatagaacataacatggataaactgatttgttctacttcattaagttacactgaagttggagaagtttgcagaactttggcatacatagaggtcacaatagtatatgtttttatcaaactgaattctaattgttagaaggtaggacagtgaataatggcaatactgcagagtggttaggagaatgtgagctttgtggtcagtcagaaaactggttcaaatctcaaccgtgtcatttaggagttgggtgtgggcaagttatttaacttgagtcttacttctcacatctgtgtctgtcataggataattgtgtattatctgaatagtgagagttgaataaattatcctcaaaattaaataaaatggaaggattcagtatgatgcctggaaggcatgtatatattaaggtctcaataaatgctatttgttttgatttattattattacaataaaaaagtcacagtgg

SEQ ID NO: 50931 - DNA, 496 bp, Homo sapiens
gaagtaacttcacagtggagaaacctgacagccaggtaggttgtcaggggtaacatcaacagtgataagtcatgttgatagtgtgtttcaagggctatgttgtgataaaagtggcactttatctctgtgatcctcctgtccaaatcccatactcccagtctaattatgagaaaagcatcaaattccaagagaggagaggcattctacaaaatactttacaggtgctcctgaaaatggtcaggattatcaaaaacaagaaaaatctgaaaaaccattactgccaagaggatccttaagagacatgatgactaaatgtaatgaagtttgtttttttaaaaaaccacaaaactgagtccctcaagaatttttttaaacctagaagtcacatactttgcaacttttattagattttagatcgcatcccactcttgaatgcatatttccccgggagcaacccatgttttaaaaaatttaataaaggaggatatcagataac

SEQ ID NO: 50932 - DNA, 162 bp, Homo sapiens
attttccctgcccatataaatacagttctgatttcaaattgtggtttgaattagggttcagtttttgtagagaaatattcagaatctctgatgggaggaaaataagggtgcttgaagaaaaagaggcatctgtagggacctttgtagtaggtgtttgacttt

SEQ ID NO: 50933 - DNA, 495 bp, Homo sapiens
gttttgcaagttatgtttaagtactatatattaaatcattacaatactgccatttatcagtgtctcaagagttaacagaaggctttgagggtatctatgggaaagccttgagaaggccatgggttactattggtgagctgttcatcatttgggttttccaaattactggaggccagattgttaatagtgttattagatccttatgtcatgatgtcctttcataagccctgcttgatttatggactggtggagcttttacaagcagttattctgtgtttggaaataagcaaagacaatcttagtcaatgtgatacaatggaaggagccctggactaaaacacagggcatccgtgtcctttccagtaatatgttttgtgattctgagtattaggttgctacatctggattgttgggcttctagtattttcacatataatttagtgaaagatttttaaacaagctgttttctgcatttagaattcttctcttgctatc

SEQ ID NO: 50934 - DNA, 321 bp, Homo sapiens
tttaccctgggttaagaatacctttctttcactttaagatttaaactaaatgacaccaaaactccaaccttggctagtaagatttttgagggcaggggaaaaaaatgccttttctcaaccacaaatctcgtgtactcaggaaacactgatttgttgggaatagaccaggtggagctctatttccagatattacaatgttggtcctgattcacagcagttgagcggctaaaagcattctaaataaggcagtgtttcaccaggtgaaggaagacaattagaaagggaggaagtctgtccttattcccatcctccacagctgcc

SEQ ID NO: 50935 - DNA, 273 bp, Homo sapiens
tccccttctaccttttaaggatcctgtgattatattgctactacctaagtgattcaggatcctcatcatatctgaagatcagctgattattatctacaactttgatttccccttgccatgtaaagtaacatattcctatttgcagggtttttgaatttggacatagacatcattgggagccattattctgcctaccacaatgattcagtgtcaggattattcagcaatacatatgagtttctacaatgggcaagaacatttagtattacaacg

SEQ ID NO: 50936 - DNA, 339 bp, Homo sapiens
ttccttaccatataagggcagaagtttagcttggctgtggtcacttggccttacacagcaagttgggtgaaaccttcttcgtataactacagtttgcatgaaataaaaagacctgacctttgatcatcccaagttccactccagttcagtcaggactttggaaacatattccagaggattgatttctagattataatattctcccaccagtattttttcttaataaccttaactggaatacttttttaaaaagtaaaagtcactgccatttttaattttctgttgttgtattggctaaaacatctggatttcatgaaaatctaggcctcataaaagttg

SEQ ID NO: 50937 - DNA, 801 bp, Homo sapiens
ttttttttttggtagagacagagtttcactatgttggccaggctggtcacaaaatcctaaccacaagtgatccacctgcctcagcctcccgaagtcctagggttacaggtgtgagccactgtgaccagccaatattattatttaatataaaatgctctaaattctaagagaaaataatacacacatatcagagtactgtgatagactcagataaaatgatacaaattatagtgttctaactatgtcaaatgtgttctaactatggtatagattttgatggcttttctccgattcaaattacattttttctgaaacaaatctaaagataagagagtactttcatcagggaagttggtttctgcaggattccctagagagatttttattcttaggtctttgaagagacttgggggtctcttttcaaagacaaaacttttgagataactttttcaacattttaaagcaaaaagttgacaactttctgccttagagatgtgaaattgttgaccttggagtgcatctccctaaaattggctgaaagtcgtgaattttgtgttctgtttcccacaatgtcatgagaaacagcccaggtgtagttggtagtccgtgctagtgcagtggctgtcactgtttcacatgacaacagagctggaaggagccctaaatagcatccaattcagggcccatattttgtaaatgtggaatgaaacttgatcgaggcaacagaccccccatgatgcggagttcagagacagtgttttgcaggattgattcagccttgaaaactcacacagctcaatt

SEQ ID NO: 50938 - DNA, 397 bp, Homo sapiens
tgtgtaactcatttgtttattaggtaagatcttcctataaaatttctaaaaggtttctagatgcatctcccattgcttattagttcaactactaagtacatatgaattaatgctgctttttcctaaaggttatatttaaggagcaggaaagcatcatataacaatattttcataatgccccaaatttctccaacatgttgttttcattatttttgtaaaataatgtcaaaattatttgacaaaattcatttctctgcaagtttatgaaactgactagtgagctgggcatggtggctcatgcctgtaattccatcactttgggaggctcaggtaggaagatcgcctgagcccacgagttccagacaagcctgggaaacaaagtgagaccctgtttcta

SEQ ID NO: 50939 - DNA, 551 bp, Homo sapiens
cttggagataaaatgagtctacctacaagcctgggaacatggtgagaccccatctctgcaaaaaacaaatgtgcgcctttggtcccagctacttaaggaggctgaggtgtgggaggatcacttgagctccagaagtcgaggctgcagtgagctgtgatcatgccactgcagtctatcctgggcgacagagtgagaccctgtctcaaaaacaaaaaaaaaaaatgagtctacctagtctgtcattttcccccaaatttttaattttaaacattagaaattgaaatgtactaagaaagtaacttgaacactaaatccctaaaaatgatatagtgatctcacaattctagaaagtgattcctgatttcatgttctattttgttcttattcttactaccaccaccctaatccaggcctttttctaatttattgctgatattgaaggagtcttttttattgtgccttagtttcttatatgcacgttgctgccaaagccatctcttaataaaaggtttgatgaatgttacaacagtaattgaaatttttccactaaa

SEQ ID NO: 50940 - DNA, 538 bp, Homo sapiens
aggaaagggtcctctttccatttccttattctgaggctagagagaagggtggattccccagttttcagggagatggtggtcatcgtgtctgcagactaggtttgctccctgggtgtggtccaactttctttctgacttgccgtcctctctgggtctccctgcagaccccaggttggcctcctgcctttctgctttctctggccttatctctctctctctctctctctctggttccattctccaggacccgcagatttcttctgcttcctgaatactcccttgaccgtgtcatgtaaccccaaggttctgctaaacagtcaaagccgattccatcggataattcgagttaaagtgtaaaaggagggtagtagcacatttctgtgaacatgtacatttgaaagttttcatctcttaacctgaaaatgtgattggaacaggcgcttcaagagtgtggaaaatatggccaggtgcggtggcgcatgcctgtagtcccagcactttgggaggctgaggcgtgtggatcacctgaggtcaggag

SEQ ID NO: 50941 - DNA, 207 bp, Homo sapiens
ctcattgtaaaacatgacaataatagcacctacttatgagggttgttttggggatcatgaagtaacccataaaaagcacttagcatagtgcctggcacgtagtaatgttcaaaaagtattaaccattgacattatcgttactaacttattatgcataagatgtgttcgtgtagcctgatggcatttggctttcactttatcagaaag

SEQ ID NO: 50942 - DNA, 204 bp, Homo sapiens
aagactcaggccttgggaacaaggctgtgactgttgttacccacacacgcatgtgagtgtgcagcctctccggggagagtgggtgacctgggggagtcaaggcaggtggaacaagccatccacttctgcactggtgccgtccactcagagaacccgtctagcagcggagatgctgctcccaagctgagagatgtggtcctgcgg

SEQ ID NO: 50943 - DNA, 930 bp, Homo sapiens
aagccctgcctcagcttctctcccaacactcagcttttctcccaatacaggaacttttggaggtcacttctggggcctttgctgagcaggccactccttgcttctcctgcagatgacaaggtttccagcatgattattgctatgactgatggaacaatgatgaaacatccatctttggacactctcaaagaaggagtacttcattgaagtcagcttgaacaacggcaaaacattcaagagcaatgtcagcatcaccagcaccacatgtactcgtggaacaaataccacggagcagcacctagcacagaggaaggccccctgccctgggcatctgtgggaaaccagggcccaagtctgcggtgagctggtgcagaaactctgagctgaggagctaacattacacccatctgcaactgagagaacctgccaggctccagcaaaaccaaacaggacattctccccaggagacaccgtcctcatccaggggaaccaggattctcatggaaaatcatttcctactgaagacgaggtcagaggaaaaactcccaggtatcccaaagagaggcagcagatacaagaaacaaggagattcaaagcccagagagtaaagagaatagagtgatctaaaaggaacattgaaataagggtgtataaaatgttcaaaaaaagataaaggaataaaactatatgacaagaacagctaattataacaaatgcagagttttaaaaggaccgaagttctaaaatgcattaatgaaaaatgaaacacaaccagaaagttcaagacaaaaagtggaataactccaaagacagatctgagcagcatctgccctgcagccccactgaccgagatggaaaccagaaacaggatgttgtgtgctgggagcagataaggagtgtctagcagggcagctcactccaccatcctca

SEQ ID NO: 50944 - DNA, 430 bp, Homo sapiens
aagccctgcctcagcttctctcccaacactcagcttttctcccaatacaggaacttttggaggtcacttctggggcctttgctgagcaggccactccttgcttctcctgcagatgacaaggtttccagcatgattattgctatgactgatggaacaatgatgaaacatccatctttggacactctcaaagaaaatcctaccatgtggttattcatggaaatggctttcagaatctaaagaaacgggatgaagttatttgcagatttatcttcagtgaaagcactatcattgggagtacttcattgaagtcagcttgaacaacggcaaaacattcaagagcaatgtcagcatcaccagcaccacatgtggcaatctggatatcttccgtgacctctctcacccaagctgctgccaggtgccatggatgtgg

SEQ ID NO: 50945 - DNA, 530 bp, Homo sapiens
gataattttatttatttaaagaacagattttgttatgtctctgtggaaacatttagtacctgttaagataaaaactaatcagaaagaaaacatcaatcctgggaaagcaaaacagacgggtgtgtgtctaaacttatggtctgcaacttggcctacagagggaagctggaggaggtgaaggagaggattctggccaataaacccctggctatgagaactgaccaggacagaagtgcattgcattgggcatgctcagccatacatacataaattattgaatttttgtttcaacttggagtgccagtgaatgataaagactatgcgagattggtctcctcttcagactgctgtttgtgctggccagaatgagactgtaaaagcccttctgggaaaaggtgctcaagtgaatgctgtcaatcaaaatggctctactcccctacatcatgcagcttccaaaaacaggcatgagattgctctcatgttactagaaggtggggctaatccagatggtaaggatcattatgaggcta

SEQ ID NO: 50946 - DNA, 343 bp, Homo sapiens
aaagactcagtgttgagactcacatgtctccccgaagggaaggaggaggcattcaagtagaaacacatttacgtcaacaggttttctgaacccccggtgaattttgagttcttagtgcaaccttcccctgcttcaccgttcctgtttcttctctgtgcctctgttttccggttggggaagtggaaaggatcctgactctggaggaaagtggagaagaaccagtgggcccgactgcatcaagagcctccccttagcagagaaccgcctggtcctcctcactcatacgtgctgtctgtgtgcagggtgctcatgggagatgttgaagaggtgtaagaaggcttct

SEQ ID NO: 50947 - DNA, 307 bp, Homo sapiens
ctgtgttgtccaggctggtcttaaacgcctgagcttaagcagtctacatgcctcagcctcctgaagtgctgggattccaaacatgagccactgtgcctggcccggcaactgttactagactatagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtaga

SEQ ID NO: 50948 - DNA, 362 bp, Homo sapiens
gccttttagacttagcacccttgcaaagctcattctttgcctctcgattgtttggaaagacacagtggtgtaagttaaaagcctgaactttagagtaaaaatacctaggtttaagtcctggttctcctctatattaactgtgtgatctttggggaagttaattaacctccctgggcctcagtttctctcatgtgtaaaatggaggtaatggcatctaccttatagatttgttgtattaaatatattaaatgaattaatacacataaggcactaattgtgttagctatttttataatcttaaccataatatttgtctgttttttcaaacaaaatttaaggatttaaagagataagatagactt

SEQ ID NO: 50949 - DNA, 998 bp, Homo sapiens
aagactcaaacttagaaacttgaattagatgtggtattcaaatccttacgtgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctgacatc

SEQ ID NO: 50950 - DNA, 289 bp, Homo sapiens
tggtctcaaacgcctagcctcaaatgatcgtcccccgctgggcctcccaagttactaggattacagacatgagccattgtgccaggtctacctttactcttgtttcaagtagaaattcactgaaaatatttcaccccaactactgaatcctttgagaagttaaaattatttacctgaatcacaagaccaattatgttttttctgaaagtctgagatcagatttcattatttttagtaataaatttccaacaacactttgtattagggttctcttagaggggcagaagta

SEQ ID NO: 50951 - DNA, 1065 bp, Homo sapiens
gactggcggcgggcgccgcggtcgggctggctgccgggcagcatggaggagctgagcagcgtgggcgagcaggtcttcgccgccgagtgcatcctgagcaagcggctccgcaagggcaagctggagtacctggtcaagtggcgcggctggtcctccaaacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggtgggtggctgcgctgggtatgctgaccccacctcccagcacccccttggcgtagggggcaggcagagggagggtttggggccctcaggaagggggtggcacttctgccaacagtctgtccctctactcggaaaacaggagccccctttcttcctgtctctcagcttctgctgccaggggccccagccggctgagagttcctccccgcccctcccaggggcttcctgcttcagcctgtcctgcacgcctctctgctgggtggcagggtcaaactgctgcagacaagcactcttccctcccagggggtccttgggggacggaaaggaacaggaagcatgcgtacagtaggtgctcataggattgccggctggatgtgactcaaaagcctaagatttgggggctactccgggcccacctgcgggtgcaccttaaatcgaggtggccacgaaaggcagggctgactgaatagccagggggtgccaggaggggccttggaggagggcagaggcagtgtgggctgatgatgtgctttggccttctcgggactgtcctgtcacccctcctcgctacagtgatgggctcaccccgccacaggtatgcatgcgcccctggggtccgtggtagggcccctccctcccctgaggacaggtgaggcaggacaggatgggggaggagggcctggcctcagtcccgggtgtggctttgattccctcctccgggcactgtccctgatac

SEQ ID NO: 50952 - DNA, 745 bp, Homo sapiens
acttacggctaggtacgaggctgggtggtggtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttacaccaaaccaacatccaaaaaaaaacccgggggcaaaatgggggggggacaaagggg

SEQ ID NO: 50953 - DNA, 4580 bp, Homo sapiens
gactggcggcgggcgccgcggtcgggctggctgccgggcagcatggaggagctgagcagcgtgggcgagcaggtcttcgccgccgagtgcatcctgagcaagcggctccgcaagggcaagctggagtacctggtcaagtggcgcggctggtcctccaaacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctagcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcccgaaggtcccgcaggaactgtggcaatggtgtgtgtgtgaaatggtgtgttaaccgcgttttgtttgctcctgtattgaataggaagcagtggccagtctgtcttccttagagatgttagcatatttttatatgtatatattttgtaccaaaaaagagtgttccttgttttggttacactcgaaattctgacctagctggagagggctctgggccgagagctttcactaaggggagacttcaggggaggatcaagctttgaaccaaagccaatcactggcttgatttgtgttttttaattaaaaaaaaaatcattcatgtatgccacttct

SEQ ID NO: 50954 - DNA, 4679 bp, Homo sapiens
taatggaagggagggtgtttggcatccccggaaggggctctctgcacagctgctcccgcggccccgtttctgcgtcttcccggaccccgctctttcttcgctacccctcgaggtgccccggcccgcgcgccacattgttctggatctcgggctgggcgcctgtgcccctccctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctagcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcccgaaggtcccgcaggaactgtggcaatggtgtgtgtgtgaaatggtgtgttaaccgcgttttgtttgctcctgtattgaataggaagcagtggccagtctgtcttccttagagatgttagcatatttttatatgtatatattttgtaccaaaaaagagtgttccttgttttggttacactcgaaattctgacctagctggagagggctctgggccgagagctttcactaaggggagacttcaggggaggatcaagctttgaaccaaagccaatcactggcttgatttgtgttttttaattaaaaaaaaaatcattcatgtatgccacttct

SEQ ID NO: 50955 - DNA, 2799 bp, Homo sapiens
taagccgggtgtagtcggacgaggactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcccgaaggtcccgcaggaactgtggcaatggtgtgtgtgtgaaatggtgtgttaaccgcgttttgtttgctcctgtattgaataggaagcagtggccagtctgtcttccttagagatgttagcatatttttatatgtatatattttgtaccaaaaaagagtgttccttgttttggttacactcgaaattctgacctagctggagagggctctgggccgagagctttcactaaggggagacttcaggggaggatcaagctttgaaccaaagccaatcactggcttgatttgtgttttttaattaaaaaaaaaatcattcatgtatgccacttct

SEQ ID NO: 50956 - DNA, 4606 bp, Homo sapiens
taatggaagggagggtgtttggcatccccggaaggggctctctgcacagctgctcccgcggccccgtttctgcgtcttcccggaccccgctctttcttcgctacccctcgaggtgccccggcccgcgcgccacattgttctggatctcgggctgggcgcctgtgcccctccctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctagcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttacaccaaaccaacatccaaaaaaaaacccgggggcaaaatgggggggggacaaagggg

SEQ ID NO: 50957 - DNA, 2925 bp, Homo sapiens
taatggaagggagggtgtttggcatccccggaaggggctctctgcacagctgctcccgcggccccgtttctgcgtcttcccggaccccgctctttcttcgctacccctcgaggtgccccggcccgcgcgccacattgttctggatctcgggctgggcgcctgtgcccctccctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctagcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccatagcccacaattagctgggtgtggtggcatacacttgtggtctgagctactttggaggtttgggtgggaggatcacttgagcctgggaggtcgaggctgcagtgaactggtatcgtgcctctgcattccagcccgggtgacagagtaagactgtctcc

SEQ ID NO: 50958 - DNA, 926 bp, Homo sapiens
taatggaagggagggtgtttggcatccccggaaggggctctctgcacagctgctcccgcggccccgtttctgcgtcttcccggaccccgctctttcttcgctacccctcgaggtgccccggcccgcgcgccacattgttctggatctcgggctgggcgcctgtgcccctccctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaagtgaggacgctgacagcactggggagggtgtgggggagggacggtggctggttggagtcgtgctgggcgctgctcgcctgccgggaggctggagctggggctgtggtctgaggtcccttagcaagattgtgtccagggccatctctgtggctggctgtaaaagtccccagccagcccctctcccaccttctcctagccagcctgtatccatccctgagaagaacctaagtaagtgctgctttggtgtttccgacagccatacttgcaaaaaccaactttttcagttgcttcagataaagatgttatagcttcac

SEQ ID NO: 50959 - DNA, 4968 bp, Homo sapiens
taatggaagggagggtgtttggcatccccggaaggggctctctgcacagctgctcccgcggccccgtttctgcgtcttcccggaccccgctctttcttcgctacccctcgaggtgccccggcccgcgcgccacattgttctggatctcgggctgggcgcctgtgcccctccctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctagcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcccgaaggtcccgcaggaactgtggcaatggtgtgtgtgtgaaatggtgtgttaaccgcgttttgtttgctcctgtattgaataggaagcagtggccagtctgtcttccttagagatgttagcatatttttatatgtatatattttgtaccaaaaaagagtgttccttgttttggttacactcgaaattctgacctagctggagagggctctgggccgagagctttcactaaggggagacttcaggggaggatcaagctttgaaccaaagccaatcactggcttgatttgtgttttttaattaaaaaaaaaatcattcatgtatgccacttct

SEQ ID NO: 50960 - DNA, 1957 bp, Homo sapiens
acattcgcgcaccgcaccgcgccgtgcgcggaaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcccgaaggtcccgcaggaactgtggcaatggtgtgtgtgtgaaatggtgtgttaaccgcgttttgtttgctcctgtattgaataggaagcagtggccagtctgtcttccttagagatgttagcatatttttatatgtatatattttgtaccaaaaaagagtgttccttgttttggttacactcgaaattctgacctagctggagagggctctgggccgagagctttcactaaggggagacttcaggggaggatcaagctttgaaccaaagccaatcactggcttgatttgtgttttttaattaaaaaaaaaatcattcatgtatgccacttct

SEQ ID NO: 50961 - DNA, 4216 bp, Homo sapiens
taatggaagggagggtgtttggcatccccggaaggggctctctgcacagctgctcccgcggccccgtttctgcgtcttcccggaccccgctctttcttcgctacccctcgaggtgccccggcccgcgcgccacattgttctggatctcgggctgggcgcctgtgcccctccctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctagcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcagtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaaggccaggacaagtcaagggggcaaagaaagcttgtctcccccaagggaagaagggaaagaatccagagtcacattggcgcagcctgggaaagagggcggtgagtccctgggcactcgagaggcctccagggaccaaagcctccctgggtctgcgaagagaaaagtttgtaccctcttcctgggtgagac

SEQ ID NO: 50962 - DNA, 283 bp, Homo sapiens
gtgatgggaattcccctggcacatggccaggtgagatgatcattcagcctgaaatgaaagaaacagcagatgtcaggaagtttttgttaatcctgccttgtgcgttagaactctcccgcatacgtcccctttcccgcacactctctctacctttctcccccatttctagctcctggtcttattcatctgtagcatcagtaaacatataccctttactgttcacatccaggtctgtaggggaaattttggttataaaaccggaagagtgtttaacctaatgtcc

SEQ ID NO: 50963 - DNA, 749 bp, Homo sapiens
aatgcagataacctgtttttcatcaaacttttatctaccacatttagcatccagagatgatttttgcctgaatcatttactttgttggtggccaaacattattttctaattctatcatttctttgccatttattaattggcattctattgtaaggagaagctttttcttcttcctatttgtttattcattttgtttaaactcatagattattttatggttataatccattgctattagtatttattttgatgcttaaattgttccaaatttaggcagaggggaactcctttctagaagctcctctgtccttttaacacatcatcatcatttttatttacttctggccacagcaagatgttctaggctcttactgttgtagccatagattctggcttttagtggtgaacaagagtaaatggtagctctatcctgtacttgcttaggcccacagagatgtcatcttgattttttttttctctgtcatacttcacattcagtccatcagcaaatcctaatggttctgccttcagaatatgtctgtatttgctactgccaacccactgtcatctctggcttaggctgctataattgcctccagactaaacttgcttctgcttttgccaccaccccactctctagtctattttcttcatacagcggccagggtaattatttttgaacgtaggttggattataccacttccttgcttagaaaacctttcatgtcttacagtcttctttagaatta

SEQ ID NO: 50964 - DNA, 633 bp, Homo sapiens
gtggtcccagctactcgggaggctgaggcagaagaatcacttgaatccgggaggtggaggttgcagtgagccgagatcgtgccacaccactccagcctgggcaacagagtgagactccatctcaaaaaaaaaaaaaaattctaaggctgatgccgagggttctagggaaaactcttcatattaagagacccagtggtggtgaatagactgttgatgtcggtcattatgtgagtacttttggaaaaataaaacagcagtacaaatactcagcacgcatttactcagcattctgctgtattatgatttaacaaaatattggctttgattcaggtggatctgggttcaagtcttgatctgtcatttactaacttctcctttgggcaggttgccctcaaagcttgtttcctttcatgctagtgagttattataggtactctagtagaaatctacatggacttcagtgggaactgaaaggaggcagtagttatgttcttcctgactgaaagaatttttttttctcctcccgagtaagttgcagacataatgtgttaatatccctttactcctaattttttgtgtgtatttcctaaaaacaaattaagtactattatctaatttagttgtcacgtctct

SEQ ID NO: 50965 - DNA, 733 bp, Homo sapiens
gtaagttgcagacataatgtgttaatatccctttactcctaattttttgtgtgtatttcctaaaaacagaaatgttctcatacatgaccatggtccaatcatcaaatcaggaatttaacacaaattaagtactattatctaatttagttgtcacgtctctctagtctccttccaattgggaacagttcctcagtctttatctttcatgaccttgacagttttgaagtgcacaggtcatttatagaatgtcatcactttgagcttgttttatttttcatgattagaaaattccacaggtgtgctgtgtcctcctcagtgtgtcacatcagaaggcatgtaatatccaagttctcatcacaagtgctgctaacagtgaccacctggtttaggtggtatccatgtttcttctctaacattgctttctacctataattaagtatcttggggggacatactttgagacagaaatgcagataacctgtttttcatcaaacttttatctaccacatttagcatccagagatgatttttgcctgaatcatttactttgttggtggccaaacattattttctaattctatcatttctttgccatttattaattggcattctattgtaaggagaagctttttcttcttcctatttgtttattcattttgtttaaactcatagattattttatggttataatccattgctattagtatttattttgatgcttaaattgttccaa

SEQ ID NO: 50966 - DNA, 1463 bp, Homo sapiens
ctcaattattcagaatgctgggctgtccctacaaagcatcatatggggtctcttaacactctggttagtttcctttgtctaaaccctctttcttaaaaagtcttctttatttttagtccatttcttccttgcagcttaagattgtgtacattttattcctataagaaatgtgaatgcacaaaactttattttcatcagaaataccaccctgttgaaactgtttcttacagcacgaaaggtaatacaggtagatgaaatgatagtggaagaggaagaagaagaagaaaatgaacgtaagaatcttcaaactgcaagagtaagtggacactgaggttggaggctgggggttatcacaagacaagcaaatacaaatgcataaaatacactgttgtacaccagagctcacagtttagtagagatgatcctactttacatggcaatgacaaaagagataattgactggtgtgcaaagtgtgtagaacacagaagaggaagctagcaagcctcccctaccccactaggacatagacaggcctttcaaggtgagtgagagtctactagctagagaagaaagggaagaggaacagtattcaggatagatgggggaggcggaaaactgaagatgaggaaaccagttagaagcctatgaattcttgaactgacatgctgacactatagaatgaagggatggtttttagataggttttagaaagaagtggcatggttggtggagaaaaggaggaatcagagacaactgcatggtttctagctaaggcaaatgctatccagtgaggtgtgggacccaggtggcagagggtgctggactgggggtggtggagcacatgccaattgcatgacatgttgaccattcattacttttccaggacatctaggctagacagaaatttcagcctggagctcagggagaagagggagatttgagagatacactgcctcccagatctttaggtgtttgtcccagtgtgggagtggagatggttgtgcagggagagccaggaagggagggagtcagggtggacactagagggagggtagagagaggagctcctaaggcagactgccaaggaagttagagaagcaggaaagacagatccatcacggaggacaagggaggagagaatatatggaagataaggagtgattcttgccagggacctcccaggccccaggaagggagcactgcagggtttgcctttgattgggcacctgggacgccctgagtgaccttcacagcagccctttatgtaaagtagtggggtacaagccaggctgcaatcagttcaaaagagatttacctttaatcttggtcaaaatcctctattttgaaaacccagccagtggaagtccttattcaattagttatgttctgaactttttaagtcattgaattctgagatacaccttattatatttagtattaactatccaaagcttgttcttaa

SEQ ID NO: 50967 - DNA, 818 bp, Homo sapiens
aataatagttttaaaaaagtttttatcttgaaatattgttcctcatattttggtggaataagcctggtgctttctggctatgtttgtcataggctgacctggatatcaccgaaataaacaaactaacagcagaagctattcagacacccctgaaatctgccaaaagtgagtacctttcaaaactccttgttgtacagaaagaactgaggctcaggttgcttgggttgggctgctcaggcagggccttgttggtagagcctcttcccttttaatgtctgggttcttaatcttgtaaatccaaaaacttgcttttggatggtgcatttagttaattttttttcccccgaacagcaattcaaacccagaaatttagttaattttagggcaggactgcctaaaaacccaaactcaagaccccgtgtgcgagcctaaaatgaaaagtgaaaaaaggggggaaaaaagctgtgcctagaaacccaaacattgttgccctgccttactttcctccccgggttaaatagatgacaagatttagagaggtgttaaaagactggtaacacccaactgagacgctccctgatgtaatcaacaaagttgaaagcgaattgaaaaaggaatgactttctctgcatataattcaaaattactcaattcaggccaggtgcggtactcacgcctgtaatcccagcactttgggaggccaagctgtgaggattacttgagcccaggagttcaagaccagcctgggcaatgtagtgagaccttgtctctgaaaaaaaaaagaaagaaagaaaggaaaggaaaggaaaggaaaggaa

SEQ ID NO: 50968 - DNA, 2463 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50969 - DNA, 2366 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50970 - DNA, 917 bp, Homo sapiens
  misc_feature (5)..(7): n is a, c, g, or t
  misc_feature (25)..(25): n is a, c, g, or t
  misc_feature (846)..(846): n is a, c, g, or t
  misc_feature (852)..(852): n is a, c, g, or t
ccacnnngcaggaaaaaaaaaaagncaaaacgaactgtgctaggtacgaggctgggtgttggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaaggctccagggtcttccagancctggncggttatcagccagcagagacggttacacttcgggatggagccttgtcgaaaaagaatctcaggc

SEQ ID NO: 50971 - DNA, 2429 bp, Homo sapiens
  misc_feature (5)..(7): n is a, c, g, or t
  misc_feature (25)..(25): n is a, c, g, or t
ccacnnngcaggaaaaaaaaaaagncaaaacgaactgtgctaggtacgaggctgggtgttggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50972 - DNA, 2516 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgtttaaaaaaaaaagaacgacatagtagtcgttcaatccctaacgactacaacaaca

SEQ ID NO: 50973 - DNA, 2430 bp, Homo sapiens
  misc_feature (5)..(7): n is a, c, g, or t
  misc_feature (25)..(25): n is a, c, g, or t
  misc_feature (734)..(734): n is a, c, g, or t
  misc_feature (739)..(740): n is a, c, g, or t
  misc_feature (752)..(753): n is a, c, g, or t
  misc_feature (757)..(758): n is a, c, g, or t
  misc_feature (774)..(774): n is a, c, g, or t
ccacnnngcaggaaaaaaaaaaagncaaaacgaactgtgctaggtacgaggctgggtgttggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaagccngggannggccagccgtgnnacannttacccagcgtgggcnatggaggtgtcatgggtcaaacgaattcaggctgaccaccaggtttgattcacgggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50974 - DNA, 2378 bp, Homo sapiens
  misc_feature (682)..(682): n is a, c, g, or t
  misc_feature (687)..(688): n is a, c, g, or t
  misc_feature (700)..(701): n is a, c, g, or t
  misc_feature (705)..(706): n is a, c, g, or t
  misc_feature (722)..(722): n is a, c, g, or t
aagagctattcataggtcggtccctgggtttatttcgtacggggcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaagccngggannggccagccgtgnnacannttacccagcgtgggcnatggaggtgtcatgggtcaaacgaattcaggctgaccaccaggtttgattcacgggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50975 - DNA, 2108 bp, Homo sapiens
cgggcagatgacctgaggtcaggagttcgagaccagcctgaccaacatggagaaaccctgtctctactaaaaatacaaaaaagttagccgggcgtggtggcgcatgtctaaaccctctttcttaaaaagtcttctttatttttagtccatttcttccttgcagcttaagattgtgtacattttattcctataagaaatgtgaatgcacaaaactttattttcatcagaaataccaccctgttgaaactgtttcttacagcacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50976 - DNA, 876 bp, Homo sapiens
  misc_feature (5)..(7): n is a, c, g, or t
  misc_feature (25)..(25): n is a, c, g, or t
ccacnnngcaggaaaaaaaaaaagncaaaacgaactgtgctaggtacgaggctgggtgttggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaagggtcttcaagacccctggcctgcgtactccagcagcaggagagcggatttacaacatctcagggaatggcagccctcttgctgacagcaaagagatcttcctcactgtgccagtgggcggcggagaggtgaagtatttccaaggg

SEQ ID NO: 50977 - DNA, 1847 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtaagtggacactgaggttggaggctgggggttatcacaagacaagcaaatacaaatgcataaaatacactgttgtacaccagagctcacagtttagtagagatgatcctactttacatggcaatgacaaaagagataattgactggtgtgcaaagtgtgtagaacacagaagaggaagctagcaagcctcccctaccccactaggacatagacaggcctttcaaggtgagtgagagtctactagctagagaagaaagggaagaggaacagtattcaggatagatgggggaggcggaaaactgaagatgaggaaaccagttagaagcctatgaattcttgaactgacatgctgacactatagaatgaagggatggtttttagataggttttagaaagaagtggcatggttggtggagaaaaggaggaatcagagacaactgcatggtttctagctaaggcaaatgctatccagtgaggtgtgggacccaggtggcagagggtgctggactgggggtggtggagcacatgccaattgcatgacatgttgaccattcattacttttccaggacatctaggctagacagaaatttcagcctggagctcagggagaagagggagatttgagagatacactgcctcccagatctttaggtgtttgtcccagtgtgggagtggagatggttgtgcagggagagccaggaagggagggagtcagggtggacactagagggagggtagagagaggagctcctaaggcagactgccaaggaagttagagaagcaggaaagacagatccatcacggaggacaagggaggagagaatatatggaagataaggagtgattcttgccagggacctcccaggccccaggaagggagcactgcagggtttgcctttgattgggcacctgggacgccctgagtgaccttcacagcagccctttatgtaaagtagtggggtacaagccaggctgcaatcagttcaaaagagatttacctttaatcttggtcaaaatcctctattttgaaaacccagccagtggaagtccttattcaattagttatgttctgaactttttaagtcattgaattctgagatacaccttattatatttagtattaactatccaaagcttgttcttaa

SEQ ID NO: 50978 - DNA, 1226 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcggctgacctggatatcaccgaaataaacaaactaacagcagaagctattcagacacccctgaaatctgccaaaagtgagtacctttcaaaactccttgttgtacagaaagaactgaggctcaggttgcttgggttgggctgctcaggcagggccttgttggtagagcctcttcccttttaatgtctgggttcttaatcttgtaaatccaaaaacttgcttttggatggtgcatttagttaattttttttcccccgaacagcaattcaaacccagaaatttagttaattttagggcaggactgcctaaaaacccaaactcaagaccccgtgtgcgagcctaaaatgaaaagtgaaaaaaggggggaaaaaagctgtgcctagaaacccaaacattgttgccctgccttactttcctccccgggttaaatagatgacaagatttagagaggtgttaaaagactggtaacacccaactgagacgctccctgatgtaatcaacaaagttgaaagcgaattgaaaaaggaatgactttctctgcatataattcaaaattactcaattcaggccaggtgcggtactcacgcctgtaatcccagcactttgggaggccaagctgtgaggattacttgagcccaggagttcaagaccagcctgggcaatgtagtgagaccttgtctctgaaaaaaaaaagaaagaaagaaaggaaaggaaaggaaaggaaaggaa

SEQ ID NO: 50979 - DNA, 485 bp, Homo sapiens
agggattctgaagcaagctgagctcagtgtctctgggctgcatggagcgagttgctgacctcagcccctgtgaggggaggacggtttgtttcagacatactctgcagggcatttcttagatgatgtgcgtgccttttgtgcccaggtaatccagcctccaccctagtgatagtgctgatgaagtcattgtctccttagagctaatatccttcctgcctgtcttgccacttctccatcccagccattccccaccactaagtgcaggatatcaggggaacctaggggttccggccctaagggccatggccagtttaacccactcccctttctattcagagcctgcgattattggccagtgacttgcagaggcacagtattgcccagctggatccagaggccttgggaaacattaagaagctctcccgtaagtctcatattcatctccacacataggatgcctccagtagctttcttgggctaccttt

SEQ ID NO: 50980 - DNA, 2343 bp, Homo sapiens
  misc_feature (5)..(7): n is a, c, g, or t
  misc_feature (25)..(25): n is a, c, g, or t
  misc_feature (734)..(734): n is a, c, g, or t
  misc_feature (739)..(740): n is a, c, g, or t
  misc_feature (752)..(753): n is a, c, g, or t
  misc_feature (757)..(758): n is a, c, g, or t
  misc_feature (774)..(774): n is a, c, g, or t
ccacnnngcaggaaaaaaaaaaagncaaaacgaactgtgctaggtacgaggctgggtgttggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaagccngggannggccagccgtgnnacannttacccagcgtgggcnatggaggtgtcatgggtcaaacgaattcaggctgaccaccaggtttgattcacgggtcttcaagacccctggcctgcgtactccagcagcaggagagcggatttacaacatctcagggaatggcagccctcttgctgacagcaaagagatcttcctcactgtgccagtgggcggcggagagaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50981 - DNA, 2422 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcggctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50982 - DNA, 1713 bp, Homo sapiens
  misc_feature (69)..(69): n is a, c, g, or t
accctgggccggcaggaacttgcttgtgattggatgttgtgggacggcggcttctcattcgtcaggcgngactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttt

SEQ ID NO: 50983 - DNA, 1717 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaagaacctgtcaaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggcagctttgttgcatgattgcatagttatatcttgctaacgggccactcatttctcactgatgtggatgaaaaaatgagagcagtatgtttccaggtgtgtgcactcaacaggcaaatagctcccgaggtcaccacttccctaatgggccacaggaagtaagttgatcatgatggggagatcacgtcacccagaaccagcaactggatagagactgttgttagtgtctgggtagagcacaggctcccaggggtcttaagagctaattactgaataaaacaatctagaacaaagcaacctaaa

SEQ ID NO: 50984 - DNA, 818 bp, Homo sapiens
  misc_feature (733)..(733): n is a, c, g, or t
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagtgggcacgtattcctctgggacgggtcgttgggtaactgatcagcaggaggttaggccgaagggcacgggtccgcagaggacaaatacgtggtnaacatgatgtatcggactacggttatgtcgatcttggtgcatcgggtcgtggatccgtgcctccttggaccatagtggttgacag

SEQ ID NO: 50985 - DNA, 2919 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaaccgtggactagtagccaaccgtggagtagtactagtccacggttggctgctccataggtatgagccagggatcctttcctggtccctaagatcaaaacccatggagcagccagcgttagatgccccacccacctgtactctggagagactgtgctggggacatgt

SEQ ID NO: 50986 - DNA, 2034 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcacctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggcagctttgttgcatgattgcatagttatatcttgctaacgggccactcatttctcactgatgtggatgaaaaaatgagagcagtatgtttccaggtgtgtgcactcaacaggcaaatagctcccgaggtcaccacttccctaatgggccacaggaagtaagttgatcatgatggggagatcacgtcacccagaaccagcaactggatagagactgttgttagtgtctgggtagagcacaggctcccaggggtcttaagagctaattactgaataaaacaatctagaacaaagcaacctaaa

SEQ ID NO: 50987 - DNA, 1297 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagggcctcactctgtcatccaggctggagtacatgagctgtgactgtgccactacactccagcctgagtgacagagaaagaacctgtcaaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggcagctttgttgcatgattgcatagttatatcttgctaacgggccactcatttctcactgatgtggatgaaaaaatgagagcagtatgtttccaggtgtgtgcactcaacaggcaaatagctcccgaggtcaccacttccctaatgggccacaggaagtaagttgatcatgatggggagatcacgtcacccagaaccagcaactggatagagactgttgttagtgtctgggtagagcacaggctcccaggggtcttaagagctaattactgaataaaacaatctagaacaaagcaacctaaa

SEQ ID NO: 50988 - DNA, 1924 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgttta

SEQ ID NO: 50989 - DNA, 998 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcggtacagtcagatttgaatttcattttaaatgtatgctga

SEQ ID NO: 50990 - DNA, 3601 bp, Homo sapiens
cggcaactggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaggcaccgtggctcatgcctgtaatcccaacacttagggaggctgaggtgggtgggccgcttgagctcaggagttcaagaccagcctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggcagctttgttgcatgattgcatagttatatcttgctaacgggccactcatttctcactgatgtggatgaaaaaatgagagcagtatgtttccaggtgtgtgcactcaacaggcaaatagctcccgaggtcaccacttccctaatgggccacaggaagtaagttgatcatgatggggagatcacgtcacccagaaccagcaactggatagagactgttgttagtgtctgggtagagcacaggctcccaggggtcttaagagctaattactgaataaaacaatctagaacaaagcaacctaaa

SEQ ID NO: 50991 - DNA, 2940 bp, Homo sapiens
caggggtggaccacaggcagtacgggacgtgggagccacaacactgctcgaactgtaggacaccgcgggaattgatctccgtgatgacccaaaaaccttggcccgtttgctgtatatgaaagagaaacctctcacttacgagcatggtgtgaagctcgcaaaagcgaaatgtctgaattggaagagacaagcttgggctcctcccgctccatcgaaaggcaaagcctgacatgctgtcagctgcacactgggggcaggaggatggggagtgccctgcccctcctgcaggactccaggtatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaggcaccgtggctcatgcctgtaatcccaacacttagggaggctgaggtgggtgggccgcttgagctcaggagttcaagaccagcctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggcagctttgttgcatgattgcatagttatatcttgctaacgggccactcatttctcactgatgtggatgaaaaaatgagagcagtatgtttccaggtgtgtgcactcaacaggcaaatagctcccgaggtcaccacttccctaatgggccacaggaagtaagttgatcatgatggggagatcacgtcacccagaaccagcaactggatagagactgttgttagtgtctgggtagagcacaggctcccaggggtcttaagagctaattactgaataaaacaatctagaacaaagcaacctaaa

SEQ ID NO: 50992 - DNA, 243 bp, Homo sapiens
gcaaggagcaaatccttttatgatgtaagtggcccaccccaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 50993 - DNA, 447 bp, Homo sapiens
agaaaattgatgccatcaggtatatatctttttcaaggtcagaatatgtgattaacacttaaaattttatatgttgagtctttatagactttaatatgtttctaactctaaaaattaattttttactgagttttttattatataactattctgtatatatgtataattcaataattatttttatttatttaagaatttagcttgggttaaatcatataacatctgctttgaattggaagattgcaatgaaatttttattcagctttttagaactctcttctcagtgatcaagtaagttattttttaagcatttctgtttgtctctttttcttgattatgtattcagatgttgtatactctacatgtacactaagatatttcagaagttataaggattgttttccttagaaaacttaacataaaggggaaagtaaaaattctgttgtc

SEQ ID NO: 50994 - DNA, 279 bp, Homo sapiens
atagagcctgtggtccgctctgaaagagaaagcctaaagatttatagtttatttttgcttctaaagagtataattttatttgattggatcttttgaatcattttgaataatggattaggccaatcccaagacattcatctaaaggagaattttcttttattgtagtttaggaagtggacgggaggctgggtacggtgactcaacatctgtaatcccagctactcgggaggtctgaggtgggaggatcacttgaccgagatcctctagatcgacccacat

SEQ ID NO: 50995 - DNA, 6686 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 50996 - DNA, 5436 bp, Homo sapiens
cggacgcgtgggtcgagaacactggtataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 50997 - DNA, 5397 bp, Homo sapiens
gattctagaggtatcccgtctcacttctgaatccctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 50998 - DNA, 5400 bp, Homo sapiens
ctctaatcttgtgtacccgaattacgaaatctgtgcttcatggatgcagacagctggcgaatccagagaaacacatgtcgggccgaattgctggattcagcggtctgtcgtctttattatctagtactgcatagacatgctgccgtcgctccatagacgccttcgcgtagtctctggtcccccacgacctggagtcagtattagagatctgagcttgcgtattctaactcgtatgctaattcggtctccatactgcttgtttcaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 50999 - DNA, 6599 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggcacacttatggagtgggatcctcaagagtcagctatcaaccgt

SEQ ID NO: 51000 - DNA, 6758 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcattatatagtagtgtggagccctgaatattcatgtacccctggtatgtcacaagttgataaaatgtctctgcata

SEQ ID NO: 51001 - DNA, 2819 bp, Homo sapiens
tcccgtgctggtgtcttggcattacctggctgcaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 51002 - DNA, 5743 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttcagagaactttggggttcttaagatactagtaagtcagttcagaattggttttcctaaattatggtggtaaatggca

SEQ ID NO: 51003 - DNA, 2639 bp, Homo sapiens
atcattttcgtttggtttatatcttctccacatcttttctaactttgcgttctattcttaaccctaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgtggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 51004 - DNA, 1195 bp, Homo sapiens
gggattctgcggtgttctagaggatcccatccggtgatgagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 51005 - DNA, 4918 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaatgtacgccattcttcctcaagtgggaatttagacattttgttttattcgtagtatattcttagtgccagtcaccccaaacacctaagcatttgagagagaaacctgcatctggttttcctgggtccgtttataatagcatctgttattatctcataacttccagttttaaggcacaaatttgaagaaaaatcttttttctttgtgtaatttttatttaggatatggtattttgatatttctatttttattaacaagacaaatatttcttttgcttagtgcctttcaagtggttgcagaggtttacataaaattaagggctaccttttggatacaaggtcccagaaatggagaaaacagtcacgaaatgtcaataggtaataggtcccactctttaattcttcgtgttatagttaattctaacacaggtcaacaacttacatcttccccaccctgcccagaaaaacaacttaccaaactgttcatctttgatcattcttgtgctgagatttcagacttttcctgttggaaatctagaaggtggctcctttcaccttggccttagaacttaactcatcctccttttttccttacatacctaactcatttacccctgaattagactgtaggcatttgagtttcttctagggaagagtcccagatttgatcagctcaggatacccccactatcctgcttcagtatttttataaaactcaatgtcaggccatgctcagtggctcatgcctgtaatcccaacactttgggaggcctaggtgggtggatcacctgaggtcaggagttcaagaccagcctgaccaacatggtgaaaccccatctctactaaaaaaaaaaaa

SEQ ID NO: 51006 - DNA, 3792 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataagtttaaaaaaggggggaaaaaaaaaaatttttttaaaaaaaattttttttccctttgggggaaaattttcccaaaggggggggcc

SEQ ID NO: 51007 - DNA, 2386 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctagctttacttacagaaatatgtattttattaaagcctgttttacatacagtgatttgtgtaaatgtaacaatattgtgagctctgaattactttggagtatatctattgtcaagttaattctctatttaccattcactctcagccacattccaggaaaataactaaagaactaagccagggagattggtcttaggaattttacaagataaagtactttgaacttagtagacattcattgagtaatgataagtattttctgaatgcttgtgtacatgtgcattttcttctttcatgtattagaatggaaataatcgtcaataaattagtagtagtaacattgccatatatctggtttcatttacagataaagtaaattcctatctagacttttgtcttcattcttctcttgaactcatttaaaaccaatattcttaaagctatcaggagggaaaacttatgcattcatttattcagctttttttttttttttcctgagatagtcttgcttttgtcacccaggctggagttcagtg

SEQ ID NO: 51008 - DNA, 1317 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacaggtaagctagctggtttattacacatattagcataaccatacaactatattgtagatatgacttgtgacctaacttcactttccaagtaggttttaactctggtatggtctcgtgttttcatttgttgtgcactaagaaatgatttcatgttcatgtaataaaattacatttaaaatctc

SEQ ID NO: 51009 - DNA, 599 bp, Homo sapiens
tccgttcaggacttgaacttcttaaggtatttttgaaacagttttgttgccatgtatttccgtggggtcataatttgccttcccttcaggatatgcaagagtcaggcttatttcacaggaaactatttgaaagatttaaaacttgtgttggaaattagatgatgtaaaagtaatgtttttacaacataatataataatgtaattattttacattataaattaatatttgtttcactgtttatcatttccatgccttctatgcttggtagtgattactgtacaatctattcttaacttagtaatagcaagatgtgactttagactttgtggacagggtatgtgactaaatctagaggagggaatatcatcattaaagggagtatttcttggtatatttgtgggattcttgggagactggcatgactagaaaaaaggggtgctttggggaatgatgggagacaaggttggttccagattgtcgagtgccactgggtaagaaaggtagtgtcacgggcttttaacctggcttacaaccagctgcagcccttgatagagctttcattggattgagtaaaagaagggaagaaattgaaggcaaa

SEQ ID NO: 51010 - DNA, 412 bp, Homo sapiens
tcatattttagtgaagcaaaattcatattttattacagatttgaagactacagtattctaatgttactatctcataaattaacatttatttgtaactttccatgtttttattatttttcagaacttaaataaacagtcctttgaccttgcaaaagtgctattgaaaagaacagtccagactattgaggcatgcattgccaatgtatgtatttctttctatgtttattctatattttgtaattcttaatccattgtattaatttattagaacctcttacataaaagtttatttagcttataaatataaaataacttatgtccagatgtgaccagggttagagaaatgcagcataagtttcatgacgtttttaaagggtggatattactataagaaaagtcgtctgcaactccc

SEQ ID NO: 51011 - DNA, 425 bp, Homo sapiens
aatgaagatagtttttgccccgatgcaaggtggagatagtgagtaaagtgaaagcacgatagtagaagaaattataatgagatatagagcctgtggtccgctctgaaagagaaagcctaaagatttatagtttatttttgcttctaaagagtataattttatttgattggatcttttgaatcattttgaataatggattaggccaatcccaagacattcatctaaaggagaattttcttttattgtagtttgtacacaaataataaagttacatactattagtgtgttgtgaaagaaaagtatttgtgtctaaattaatgtgtttttttttttaacaggacatatttttgtttattaccagacaattaaaaggtttggaggatacaaagagtccacagtttaatagatacttttatttattagag

SEQ ID NO: 51012 - DNA, 314 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaaggggaaaaccaactgccttttcacttgagctgtctagaaaggcccatgtagtgtggaactgaagcctttcaacaacagcaagtgtcaacttagaaccgtaagaatgagttaccttcaaaacacacc

SEQ ID NO: 51013 - DNA, 5795 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaagtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 51014 - DNA, 6650 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 51015 - DNA, 3121 bp, Homo sapiens
accctgctgtacatccaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 51016 - DNA, 5233 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtca

SEQ ID NO: 51017 - DNA, 4475 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaatgtacgccattcttcctcaagtgggaatttagacattttgttttattcgtagtatattcttagtgccagtcaccccaaacacctaagcatttgagagagaaacctgcatctggttttcctgggtccgtttataatagcatctgttattatctcataacttccagttttaaggcacaaatttgaagaaaaatcttttttctttgtgtaatttttatttaggatatggtattttgatatttctatttttattaacaagacaaatatttcttttgcttagtgcctccctttttcattagtatgaaagtatgtatcttaaagggttgctctacgaattaaatggatcagtaaatataaagaaagcgcctagcaaagtgcctagtacaaaataaacgcccaactgttattgttac

SEQ ID NO: 51018 - DNA, 2777 bp, Homo sapiens
ctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaacaagaatggaaccactgtggtctccagatgaagagtttccccttaagtactagcaaggtacaggcgaataaattctggtaaagcggctgtggggttgtaaaaaaacgtctaatttggcattaaaccttggttttacagacagtggtgtaggaggggacgaggaaacaagggcacaagaagttggcgggaaacagaggggcaaaaccacctgtggattttttatccctcaattatgtagtctaggagtagcagaaaagaaagacagatgggaacatgag

SEQ ID NO: 51019 - DNA, 287 bp, Homo sapiens
tacagactcaggttatagggtgtgattttctaagtcaatattcagtttcacagccagaatctgtgaagagagaacaaaccatgagaaaactaacaattttatggtgattgagaggatccaagttcctggagttttaaaaaaatcagtttttaaagataaacaaactaaaactagtccaagcactgagacagagtattaaaagatggtagcacacccaaagagcacggtgggtcttgaatagctaacatgtttcaagtagtggaggaagatgtgcttaaatagttacc

SEQ ID NO: 51020 - DNA, 391 bp, Homo sapiens
caaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaattta

SEQ ID NO: 51021 - DNA, 204 bp, Homo sapiens
atttaacgtttgttctcaaaaaatggtcattttgaaaagtgaattggcaggtggaagcttttagcccaaaagaaatctgggtttcagcacaataaactgtatttcatcagggaggactaactttgctttttttcacactttatttaaatgtggatattttttcatgatacagaataaaatgtgcattttatggaattaatttga

SEQ ID NO: 51022 - DNA, 554 bp, Homo sapiens
atttggaagaagcccgcaggaggttttattcatttcctggggctgtaataataaagtaccaaaaacagagtggcttaaaacaacaggaatgtattgtctcacagctctggaggatagaagtctgaaattaaggtattttctgggccatacttcctccaaaactcgcaggggagaatccttccttgcctcttcctagcttctgttggtggcacttgatctttggagttccttggcttgcagccacatcactccatgatctgcctctgtcatcacatgatgctctccctgtgtctttttccaaattttcctcttctaaggaccccagtcatgctggattagggtccaccctaattacctgctcttaactaaatacatctgtaaagactatttccaaataaggtcacattcacaggtcatgatttttgcaaaggcacctttaggtctttgttgttctgtgttagtatcttctgcttatgtcctttcgtggccattgttatgggtgaaactatgtcccctgaaaaagacattgaataaaaatctgacatagttggctc

SEQ ID NO: 51023 - DNA, 246 bp, Homo sapiens
aggattttcacagctgttcagagtgagttagcacaggcgttgtgggaatcatgatgcattgggaaaagtctttgctcctaacagcctcagattccacctgctcagtggatggtagtgggcagcactggtgcaggtgaaaggcagttggtgagaccattagcagcctctggggtctcatcctgcaatggactttcccttgccatggagtaccatgggaagaacttggacttggtgccaaagagccag

SEQ ID NO: 51024 - DNA, 1043 bp, Homo sapiens
tctgtcaggagacctgctgccgccccagctgctgtgagaccacctgctgcaggaccacctgctgccgccccagctgttgtgtatccagctgctgcaggccccagtgctgccagtctgtgtgctgccaacccacttgttcccgccccagctgctgtcagaccacctgttgcaggaccacctgctaccgccccagctgttgtgtgtccagctgctgcaggccccagtgctgccagcctgtgtgctgccaacccacctgctgtcgccccagctgctgtgagacgacctgctgccaccctaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctgagcccactgccctggcttatctcccccttcaccactggcccacagatgtagacccttctactgtgctgaccattaggatacaggaagtggggttgatgtcattcaatagaatggaactcatgtttccaatgagcccatcaccatttcactgactctttgagaacattctgattcattttaaactccctcccttgctttctttttcttccggtggtggcaccaaatgtgaattaatttgtaatccactagctagaaattattccaatcctctaatttcctcattttctttatcactttgaggtacagatcttcttctcagtgaggcagacattatctgcaggaccagttttgtcactgaggttgcaccctcagatccagccgcccagttatattctgtgtttctcctagtgtgaatttcttatgctttgttgcatctctgctttttaataaaatttctgtacataag

SEQ ID NO: 51025 - DNA, 448 bp, Homo sapiens
gggaaattgatgagttgaattcagaagacctggttctaatcctaactgtgctctctaattgccgagcacaccctgagcatgtcctttgacttctcagggcctcacttttcccacctttcaattttatgaattttaaatattccaccaataatttctagcatgatatccattgttaatatccactatctaaccagaccccagatttacgtaagcttgttttaaaatttgggcaggagggttaggtgccctgctgtgccccatagctcatggcacagtgacatcatctgtctattcaaaagcccttttcttagtccatgaaatcatccttggtggcaaatcgaatcatatgaggagttttagaaattcccaacaaccagacggtacctcagaccagtaaaatgagaatctctcagttgggacccaggcattggtcactcttagacccatt

SEQ ID NO: 51026 - DNA, 415 bp, Homo sapiens
gtaaaggccacggaggatgaaatgtaagcagtagccaacaatatcagctaagattttttaaaatgagaattatataaatgaatgtatgtaacaacatgtagtgtgtaatcaataaatgctggcacctcctgagagctgtgacattattttttttgttttggtaaatttgttggtagtgttcttccaaaatatattgtttaatataaagtatgcttgaattaattttattaagagaagaactgcatattattccattcaataactgaaaaacttccaatgagatttgataattatcattactcaaacacagatggactctgtatcgttttgcagcacacactcacctatcagtgatatttgcatccacctcatattaagtctgtatcaaatacttatatatccccaaggtcactca

SEQ ID NO: 51027 - DNA, 421 bp, Homo sapiens
tgtaaattgccattatactgcccaaaacccagaaatcctattctttcatttagcagttaataattaagcacctattgtatcccaagtaccatttcaggtgctgtaaatatagtattgaacaaagcaaagtccctcttcttacgggggattttctattacttactgccatcttacccttgctgatgaatgcctatcataatttaaagaagctagaagacagatttttgtcagtttttttttttatagataggggatctcactatattgcccaggctggtctcaaactcctcagctcaggcagtcctcctgccttggcctcccaaagtgctgggattacaggtgtgagccactgcgcccagcatcaatttttaattttactattttctaagccagttttttaaaaaatgtaagaattaaaaca

SEQ ID NO: 51028 - DNA, 267 bp, Homo sapiens
taggaattatgagaggaaagttgtaaagaattacagtgaaccagaagctaactattcagtaaatgaactaaaaatatagctttttaatttattgagctttcttttttaaatttttatttatacctaaattcagacttaaaaccaaaatagtgctgggagtggtgcctcacacctgtaaccccaacactttgtgaggccgaggtgggtggatcatggggtcaggagattgagaccatcctggctaacacggtgaaaccctgtctctac

SEQ ID NO: 51029 - DNA, 283 bp, Homo sapiens
actcaggagtctgaggcaggggaatcacttgaacctggaggcagagattgcagtaaccggagatcgtgccattgcattccatcctgggcgacagagcgaaactccgtctcaaagaaaaaaataaaaggactatgagtgggagcagatgtagggagatgcaagggacggagtatcaggagaacagtacctgttctgggctctccgctaatcaaacccaaccaccaggcagaggcatgggagacccccacacacagagcagggtggagacaggagaagcgatcgc

SEQ ID NO: 51030 - DNA, 186 bp, Homo sapiens
tttctcttctgataggcagggactcaaaccaaggttcctctgcacctcggaccctgtgatttaccaccaagggtcggagccatcgtcctttgcccaagacaggcaatcagatctcctcggagttttcagatcccctctcctctccatggccttccacaacctcccaacccctgacctgtcacttct

SEQ ID NO: 51031 - DNA, 346 bp, Homo sapiens
tttttcccccacctgcttgacctgagagctggcatttccagggtttgcctcaacccttgccccacccccgccctgccccagagttcttctggatggccccgtttcagtctgaccccaaagaaaaagagcacaagctggatttgagcagtgcatgcaacagccaaggctgagggggccaggaccacagccgctggtggggggtgccactggctccccacacccaatccctggcttggcccagaccaggacagagcagatgggcacagaccacatcattcctctgagaagcagcaggcaggcagccccccactgacggggcaggcccctcgcaggcatgcagcgaggc

SEQ ID NO: 51032 - DNA, 3009 bp, Homo sapiens
ataagaaaaaaaatattttaaaagggtaaccgttaaacagctaggacctgcaacttcagtgcttctgggataactggaacatcagaaggacagattttattacagcataatcacacctcatttctttcatcagcagttgtcaccagacgctgttacttcctaaaatggcggacaatcttcccacagagtttgatgtggttataatagggacaggtttgcccgaatccatccttgcagctgcatgttcaagaagtggtcagagggttctgcatattgattcaagaagctactatggaggaaactgggctagtttcagcttttcaggattgctatcctggttgaaggagtatcagcaaaacaatgacattggggaagaaagtactgttgtatggcaggacctgatccatgaaacagaagaagccatcactcttcgcaagaaggatgaaactattcaacacacagaagcttttccgtacgccagtcaggatatggaggacaacgttgaagagattggtgctctgcagaaaaatccttctttgggggtgtctaataccttcactgaagttctggattctgcattacctgaagaaagccagttatcatattttaatagcgacgaaatgcctgcaaaacacactcagaaaagtgatacagagatttcactagaagtaactgatgtagaggaatcagtggagaaggaaaagtattgtggagataaaacttgtatgcacacagtttcagataaagatggagataaagatgaaagcaaatctacagtagaagataaggccgatgaaccaattagaaataggattacttactctcaaatagttaaagaaggcaggaggtttaatattgatttggtgtcaaaactgctgtattctcaaggattgctaattgatcttttaatcaaatcagatgttagtcgttatgtagaatttaaaaatgtcactaggattcttgcatttcgggaaggaaaggtagaacaagttccttgttccagagcagatgtctttaatagcaaggaactcaccatggttgaaaagaggatgctaatgaaatttctcacattttgtttagagtatgaacaacatcctgatgaataccaagctttcaggcagtgttcattttcagaatacttaaaaactaaaaaactaactcccaaccttcaacattttgtactgcactcaattgcaatgacatcagaatcatcttgcactacaatagatggtcttaacgcaactaaaaacttccttcagtgtctcggacggtttggcaacaccccctttttatttcccttgtatggccaaggagaaattccccagggtttctgtaggatgtgtgcagtttttggtggaatctattgtcttcgtcataaagtacaatgctttgtagtcgacaaagaatctggacgatgtaaagcaattatagatcactttggtcaaagaataaatgctaaatattttattgtggaagacagttacctttctgaggaaacatgctcaaatgtgcagtataagcagatctctagggcagtactcattacagatcagtctatactaaagacagatttagatcagcagacttccattctgatagttcctccagcagagccaggagcttgtgctgtacgggtcacagaattatgttcttcaaccatgacatgcatgaaggacacctatctggtacatttgacatgttcatcttctaaaacagcaagagaagacttagaatcagtggtgaagaaattattcactccgtatactgaaacagaaataaacgaggaagaacttacaaagccaagactcttgtgggctctttattttaatatgagagattcctcgggaatcagcagaagctcgtataatggcttgccttccaatgtttatgtctgctctgggcctgactgtggcctgggaaatgagcatgctgtcaagcaagctgaaacacttttccaggagatctttccaactgaagaattctgccctccacctccaaatccagaagacattatctttgatggtgatgataagcagccagaggctcctggaaccaataatgtagtaatggccaaactagaatcctctgaggaaagcaaaaacctagaaagcccagagaagcaccttcaaaattagaaaagagcaatctcgaaatgctgttttggacctccttcatggcatcagaattttctcatttaaaggacagtttcccatatgagtaattagaagtggttatatatgatgaatgctatgcagatgttgtctttaactctcagacattcagcattgaatatctttgttaacctatcaatgagtgatttattgattattgaacattttgtttagaatgggctatatgacccagaatcttaaaacagagttagctttattttagtattgggtatatatgtaagggttccatattagcaactcagcttaaaggtaatgtatttgctaatgatcttcagattttatctttgtctacagaacaattagtaatacccaagtaatattttaattacttttgcagctgttacagttgctgcggcctgttcgaatagtgaaacatacacaaatggtaaattatgtggatcttttgcatataatataaatgtatagacatggtggtaggaatagcaactaatacaaatgccaatatgataataaaatacatttgtctataatcgtttaacaaaaaaaaaaaaaaaaaaaaaaaaaaaattgtggcggggcgcgcccggggcccggaaaaagttttcaaaaccttggcgtggggggcgcgggggccccatgggtacggggaaccggggccaaggggggacccaaagagaaacccggggccaagagacaacaggcgcggggtttctctcccaatttaaaagaggccggggggggaaaccggaggggtttttggcacaaattccaggaaggggagccggaaggcacatacggggggcctatcacaaggagttccaaggagatcggatatcaatttagccgcgaggggata

SEQ ID NO: 51033 - DNA, 7081 bp, Homo sapiens
ataagaaaaaaaatattttaaaagggtaaccgttaaacagctaggacctgcaacttcagtgcttctgggataactggaacatcagaaggacagattttattacagcataatcacacctcatttctttcatcagcagttgtcaccagacgctgttacttcctaaaatggcggacaatcttcccacagagtttgatgtggttataatagggacaggtttgcccgaatccatccttgcagctgcatgttcaagaagtggtcagagggttctgcatattgattcaagaagctactatggaggaaactgggctagtttcagcttttcaggattgctatcctggttgaaggagtatcagcaaaacaatgacattggggaagaaagtactgttgtatggcaggacctgatccatgaaacagaagaagccatcactcttcgcaagaaggatgaaactattcaacacacagaagcttttccgtacgccagtcaggatatggaggacaacgttgaagagattggtgctctgcagaaaaatccttctttgggggtgtctaataccttcactgaagttctggattctgcattacctgaagaaagccagttatcatattttaatagcgacgaaatgcctgcaaaacacactcagaaaagtgatacagagatttcactagaagtaactgatgtagaggaatcagtggagaaggaaaagtattgtggagataaaacttgtatgcacacagtttcagataaagatggagataaagatgaaagcaaatctacagtagaagataaggccgatgaaccaattagaaataggattacttactctcaaatagttaaagaaggcaggaggtttaatattgatttggtgtcaaaactgctgtattctcaaggattgctaattgatcttttaatcaaatcagatgttagtcgttatgtagaatttaaaaatgtcactaggattcttgcatttcgggaaggaaaggtagaacaagttccttgttccagagcagatgtctttaatagcaaggaactcaccatggttgaaaagaggatgctaatgaaatttctcacattttgtttagagtatgaacaacatcctgatgaataccaagctttcaggcagtgttcattttcagaatacttaaaaactaaaaaactaactcccaaccttcaacattttgtactgcactcaattgcaatgacatcagaatcatcttgcactacaatagatggtcttaacgcaactaaaaacttccttcagtgtctcggacggtttggcaacaccccctttttatttcccttgtatggccaaggagaaattccccagggtttctgtaggatgtgtgcagtttttggtggaatctattgtcttcgtcataaagtacaatgctttgtagtcgacaaagaatctggacgatgtaaagcaattatagatcactttggtcaaagaataaatgctaaatattttattgtggaagacagttacctttctgaggaaacatgctcaaatgtgcagtataagcagatctctagggcagtactcattacagatcagtctatactaaagacagatttagatcagcagacttccattctgatagttcctccagcagagccaggagcttgtgctgtacgggtcacagaattatgttcttcaaccatgacatgcatgaaggacacctatctggtacatttgacatgttcatcttctaaaacagcaagagaagacttagaatcagtggtgaagaaattattcactccgtatactgaaacagaaataaacgaggaagaacttacaaagccaagactcttgtgggctctttattttaatatgagagattcctcgggaatcagcagaagctcgtataatggcttgccttccaatgtttatgtctgctctgggcctgactgtggcctgggaaatgagcatgctgtcaagcaagctgaaacacttttccaggagatctttccaactgaagaattctgccctccacctccaaatccagaagacattatctttgatggtgatgataagcagccagaggctcctggaaccaataatgtagtaatggccaaactagaatcctctgaggaaagcaaaaacctagaaagcccagagaagcaccttcaaaattagaaaagagcaatctcgaaatgctgttttggacctccttcatggcatcagaattttctcatttaaaggacagtttcccatatgagtaattagaagtggttatatatgatgaatgctatgcagatgttgtctttaactctcagacattcagcattgaatatctttgttaacctatcaatgagtgatttattgattattgaacattttgtttagaatgggctatatgacccagaatcttaaaacagagttagctttattttagtattgggtatatatgtaagggttccatattagcaactcagcttaaaggtaatgtatttgctaatgatcttcagattttatctttgtctacagaacaattagtaatacccaagtaatattttaattacttttgcagctgttacagttgctgcggcctgttcgaatagtgaaacatacacaaatggtaaattatgtggatcttttgcatataatataaatgtatagacatggtggtaggaatagcaactaatacaaatgccaatatgataataaaatacatttgtctataatcgtttaaagattagctttgcatgatcctttatgcactgtgaaggtctgaagtttataatactcacttgacccttgtaactgatgaggcaatgatgccaccacagtattctaatttacaaaaagaattggagttcaattagtggttgtaaagctcattttggggaggttgattgcaaaggaaatttgaaagataagatttattcttatttaatacttcagaaaatttctgcagagccctgccctggcacttaaaatagcttccaataagtaacttagaccaaaaggaaaaatgaagtgccccaggagaagatacttcagaagggctgttctgaaattcctaaggaggaattcttaggaattcctaaggagaaacagagtgaggcctttttaacctgagattacagatacttataaaaccctctataaatagattacccaaggtttttcagtgagaatgaaacataccaccttgttggctctaccactttaattaatatcactataacataactgataggaatgaatcaaaggaggatttaccatgccctttcggttgtgtcccacttaacaaattgtgaagtaacaattttctgtaatctctcttgcctcttagctgttatccagagtatagaaactttttttctcccagagccacccaacgtcataaaactggtagtactctaatggtgaaaacctgtggagctgtcagaagacatgaacttgcttttcctctagtccagtttccattcttcagtcagagtatgatgatccctgtgacagtttttgctctgaaatagtatttatcatgtgtttggtacctagtattatgctttctcatgacagtttctcaacaatcctgtgaggcaaattcgcatgtaccctctgtattagtgtgttctcatgctgttgataaagacacacctgagatggtaatttgtaaagaaaaaggtttaatggactcacagttccatgtggctggggaggcctcacaatcatggtggaaggtgaaaggcacgtcttacatggcggtggacaagagagaatgagaactaagtgaaaagggaaacccttttaaaaccatcagatatcgtgagacttatttactaccatgagaacagtatgggggaaacaactccatgattcagttatctcccaccaggttcctcccacaacacgtgggaattataggagctacaattcaagatgagatttgagtgggaacacagccaaaccatatcaccttcaaagaagaaataagagaattattagtaatttgctcagaatctggtatgtggaagagccaacatggggacccagccttttgtgattctaaaacctttgatctttctactaacattcactgttagagagtgtaggcgctgcaggagaaagagaaagtgcccacgaaaattagtctagcattgccgggggtaaaaagcacacactggtcctgcagcttattgaatcagagaaatgtgaagataagatgaactaaacaaacatattttagagcatggatctcgaagcagaatttggctaaattttaacaaaatgttcttcagtaacacatctcatgatctgaagattgtgttacaaaaaatattatcaggccaaaatttgttcggaatacactaatttttgctcctctatatgtgaggaaaatgagactagacagatttaagtaattgacaacttacttaaagtagcaaagtcatggattgtattgacttttaaaaatatagtaaaagtcatatttaaactttatcctaaagtttaaatctaacagaacaactgaaatacttgaaatagacctataaaatagtaattaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttacaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattgacaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaattatttaatagacttctcggagtctgttaagtacttaaaccaagaactaccattattcctactgggaaaacataaacatttctcaagtggaaagtaaacagtgttggcactatttttatatatggttaaagagacctgtcattgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaagctatttgcattacacatggatgcactcagtttttgtaaaactatatgcatatccataagggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggaaaaaaaaac

SEQ ID NO: 51034 - DNA, 772 bp, Homo sapiens
  misc_feature (83)..(83): n is a, c, g, or t
  misc_feature (136)..(136): n is a, c, g, or t
  misc_feature (138)..(138): n is a, c, g, or t
  misc_feature (143)..(143): n is a, c, g, or t
  misc_feature (148)..(148): n is a, c, g, or t
  misc_feature (150)..(150): n is a, c, g, or t
  misc_feature (156)..(156): n is a, c, g, or t
  misc_feature (160)..(160): n is a, c, g, or t
  misc_feature (164)..(165): n is a, c, g, or t
  misc_feature (169)..(169): n is a, c, g, or t
  misc_feature (175)..(175): n is a, c, g, or t
  misc_feature (177)..(177): n is a, c, g, or t
  misc_feature (181)..(181): n is a, c, g, or t
gggggacaatttcaggcctaggccaggggattcccagagaactcagtcacttagtgctgtttgaagtgcctgcacaggatgantaccgcaatagtggcaactgagactagatgctgatattctgcacctacaggtngngcccncgaangnaaagtngtanatgnnctgngggtgncnggtngatttcttgctttttcttttggactacttgtagagtgcttattatgtcccagccactcgtaattctatcctcacaggaatgaagcataggtacaattattacacctgttttccagatgaggaaactaaaggtttaagtggctaagagaaacctttttgtcctccacctgtgctgctccttctcttcctgtccaggccttcttcccattcagactcactctctcattgacctctcagtttcccttcaccagcatctccccatctgccctcttttgtctgtgtctaccggtgtatcctttgctcaggtcctcatctcttcatatcttggcaactgttgtgacactctccatgccatcatttggactctagaattgttttatctaaacataattgggtcatgtctgtgtgtatgtgtgtgtgcacatgcatgcatgtgtacgtgtgtgtgtgcacgtgtgagggcaaaaagatacctcctaggcctggcgtggtggctcacacctgtaatcctagcactttgggaagcagatcgcttcagcccaggagttcgacgccagcttgggcaacatggtaaaacccaccctgtctctac

SEQ ID NO: 51035 - DNA, 279 bp, Homo sapiens
cctcgctattcatcggcacctggagattttgcagcagaggagacttaagttataccttaagttggctgtttttgaggtggctcttgtgcatggattgagttgacaggcagatagttgagcaatctggagagctttgaatgtctgaatatttcttagcatcttaactaggttagtagctccacggaaatgcaaaagattggtaacattggtgccgatgaatagcgaggtgccgatgaatagcgaggtgccgatgaatagcgaggtgccgatgaatagcga

SEQ ID NO: 51036 - DNA, 825 bp, Homo sapiens
cctcgctattcatcggcacctggagattttgcagcagaggagacttaagttataccttaagttggctgtttttgaggtggctcttgtgcatggattgagttgacaggcagatagttgagcaatctggagagctttgaatgtctgaatatttcttagcatcttaactaggttagtagctccacggaaatgcaaaagattggtaacattggtgcctggtttgttgtcagggttggaactttcttgctttttcttttggactacttgtagagtgcttattatgtcccagccactcgtaattctatcctcacaggaatgaagcataggtacaattattacacctgttttccagatgaggaaactaaaggtttaagtggctaagagaaacctttttgtcctccacctgtgctgctccttctcttcctgtccaggccttcttcccattcagactcactctctcattgacctctcagtttcccttcaccagcatctccccatctgccctcttttgtctgtgtctaccggtgtatcctttgctcaggtcctcatctcttcatatcttggcaactgttgtgacactctccatgccatcatttggactctagaattgttttatctaaacataattgggtcatgtctgtgtgtatgtgtgtgtgcacatgcatgcatgtgtacgtgtgtgtgtgcacgtgtgagggcaaaaagatacctcctaggcctggcgtggtggctcacacctgtaatcctagcactttgggaagcagatcgcttcagcccaggagttcgacgccagcttgggcaacatggtaaaacccaccctgtctctac

SEQ ID NO: 51037 - DNA, 398 bp, Homo sapiens
gactcttggatgatggtcttggaatctcagaagctcacagctggaacaggccttctaagctcaactccttaattttgcaaatggaagactgaggcccagaaagggatggcggctccatggagttttgaattcccacccctcggtcctgagctcttttcccaaagattgtggtggaagctgtgttgatgggtgttctaaccggttcatctgaattcctcgaatgtggattccaatccttcatctcacatgtgccataggtttgcattcgagtatatacaagttatcaattgatgaataagaagttatcccccaacacgtagtggctgtaataaaaccaacaataaccatttataatcttccacagtttctataggtcaggaactggggagcagcttagc

SEQ ID NO: 51038 - DNA, 462 bp, Homo sapiens
ttctttagggcctttgggttgtgtttgtaacatgtatccacaatcagctgtcataataagccgagcatcctgattaattcactgtaccctccagtcgaagtattcacggatgtaactagttgaaatgcggatacacaagttcctactggtcttaaaagaaatgatttttctggtagttttataattttagcaattcagatttcgtacatttgaggttagaaaattcagcagacagcctaaatgcggcatcatgctaatggagtcctggaagctgctggtgttaaaatgagtaaattaaggagtcaacactgcttatttaggcacattaggataaaatagtatgagagctcggacttaacaaaaatcaattcagcacgcagagtgcacatccatcagggctttgttatgatgtcagggcgagcagcaaccctgttttattttatgaagaatgctacattagca

SEQ ID NO: 51039 - DNA, 368 bp, Homo sapiens
cctgggggcccctcaactgcacgttgggtcctgcctttatccagcccacgtcacctgcctaccttcctcccctgctccccagagtggcgcgggttgccacacgggtctgctttgggttggccgggcgtgccagcctcctctgcccctggactgcagaagtgtactgtccatctctttcctggggaatctctgtccagtatatgctttaccatttttgggatactcttgctccccaagactgggccacatgccctcatctgggttctcagaacaccccacactctgcctgccgcccaccaactcgctgggctgtggtggcctctgtcccatgctccacagtgagccctcaggactgagttaagtgcctt

SEQ ID NO: 51040 - DNA, 215 bp, Homo sapiens
ggaacttgatgagatcttttaatgcgggtggttagaataaagataaaaccctggagcagaattaggaaaatgggatcctttggtggccaggagacttgcagagtgtgggaagaggaagggagagagcagggccctccaggagctccctccattgcccaggtctgccctgacttggccaagccactgttttttcatggcatgcaaaggtggcaagt

SEQ ID NO: 51041 - DNA, 655 bp, Homo sapiens
agagctcctccatcaagctcagtgggtggggaatgggacggaaagccatcacttgctcagctcaacgtcatctccccttcgcctgctctacctcagttagaaaggcccaactgggaacacaaagacttctggtttcagggccaagaaaccagcttcccagccagggagcaggaactcacttcagcaagttgtggaaaataatggcaaaagcaatgatgcaaaaatgcctgatgaataccaaggcctcaacttcattaaagaaaggcccatccttcagtccacagatccctccttgcccctgtggccaccacacacccaccagcctttatctcctagagaagcggaacaggaatgaggatctgatgagcaccagcgcttcagtgacaaaacatagtgacttaccaatgtttggggttcttacatcattgaagggaaagggcaagtcacaaaaggaaccatatcaacttatgtaagacatggcacggaacagagaaatttcgcagagaagaacagcaaactcaccacttgctaggattcatgaaacctcccacagttgcagattgccccaaaccatgacatcagggaggctgggaagccacccaacttcctctatttatcaagctggctaaaacccagggtaataccagcgtgaccc

SEQ ID NO: 51042 - DNA, 297 bp, Homo sapiens
tttttctgaaactagtctttgacatcttacgtccagaaatatactgtcctggaatggacttgtagagagaaccagtatctgtgaggctaccagaaaacagctgatgggaagggctaatgttttctgagacgatccccagaatgtgtactttcacccgcacccataacagtgctttccagaggtgtctcctgctcggaagtttctctcacagcttatcttaaaaagccctttattgctgtttttattttaaaacaactatttattttagacttgcttctaaaacaaagagaattgatt

SEQ ID NO: 51043 - DNA, 486 bp, Homo sapiens
taaaaaataataatcttctcaagatacaaataacataacctaatactccctcaaagcagcaacaacagcaaaacagcagctctctgcaaagaagttctttggaaaagttccttcctatctccacattctgtcttctttgggcaccttgttctagccaaaaggtagaagagttgtagagatggttcttaatcatttccttcatgaattctttatttgagtgaatctgtgtatattatttttatcattaatatctatcatattgatggctcattcaaaactgaagacagtccattttaacataatttataatagagatggtgatatggtttggctgtgtcctgacccaaatctcatcttaaattgtagttcccatactccccatgtgtcgtggggaggggacccagtgggaggtgattgaatcatggggggcggttaccctcgtgctgttctcatgatagtgagtgagttctcacaagacctgatggc

SEQ ID NO: 51044 - DNA, 501 bp, Homo sapiens
taatgaggtggcttagggtggcatctctagatagcttcagggtagaggctggttaccagaaagaccaaacagttgattagagggtggagcttttagccctattccccccacctcccttgtcctgtgccccactcccgccccttcccttgtcctgtgccctactcccgccccttcccttgtcctgtgcctcttcctctggctgtttctgagtttaggcctccataataaatgggcaatcattaagtaaaaccctttcctgagttctatgaaaagttgtagagaattatggaacctgagaggggcctgtgggaacccgtgaatttgtagtctactggccactggtgtccgaagtgtgggcagtcttgtgggactgagcccttgacctgtgggatctgtgttaagacactctgcatggttattgtcagaaatgagttgtattgttgggcacctgttggtacctgttggattggtgtgaagagacaccatgcatttgatgttaga

SEQ ID NO: 51045 - DNA, 184 bp, Homo sapiens
gaggaaggagaacggtttttatgttaaaaacagataagtccagccacagaaaaggttaacagtcaaatggaccaaaaggactaggtgacaagtatgttctggatgaagatgagagtttgtttccatgaaaaatcgtcctacagggaaaatgctctccagggcagatatgttccctttgcatggc

SEQ ID NO: 51046 - DNA, 550 bp, Homo sapiens
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctggtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaatag

SEQ ID NO: 51047 - DNA, 668 bp, Homo sapiens
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctgaactaaatgcactccaggaggagctgaagccctatggtctagttgtgttgggctttccctgcaaccaatttggaaagcaagaaccaggagataacaaagagattcttcctgggctcaagtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaatag

SEQ ID NO: 51048 - DNA, 1046 bp, Homo sapiens
aaatatcttcattttactcatggggaaactgaaggccagggatgggaattgcccaggttcacaaaggaatttaacaatggagctggcttctgattcccagggcagtgttctttctactctacctgctgatgagtggagtaagaggtcagaagacctggggaaagataagcaactaagatatcctaaaaatagttcagcaatttaaaaccctcccttctcagagagtccagacaggaggccttcaatccagagccaaggagtagcctgttttttacagaagcatgtaagattacacagatgccaggaattattgttaccagtattatcacttaaaaaaaatcttccagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctgatttccaggggaatcaatatatacttgagaactaggagcctctcagaagattccagaagtcttcttgataaatacaggacagaagacccatgtttttgagacttttgcaaggttttacagaactaaatgcactccaggaggagctgaagccctatggtctagttgtgttgggctttccctgcaaccaatttggaaagcaagaaccaggagataacaaagagattcttcctgggctcaagtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaatag

SEQ ID NO: 51049 - DNA, 794 bp, Homo sapiens
ggcgcctgtgtttcagcaaagcctgggcaattggaacgcagggctcctaagattccatgacacccccaccttctaattctgttattgcaactgcagaccgttacctggcatgctggctgccacctccctcactcttgtcagagtctgagctacaggcagtgccttcagctctgagctcaggcgtctcaaaccttgtttttgcgattaaggactctcaagtgctgtggagagtgatcacgtttttctcaacatccctggctccacctcttctgccacaaacatcagcatggtggtgtctgccagcccttcatccagtgtgagaagacagagatgaacactggagaaatcaacaagaaattgcgcccccagccggcagagaacaaacagcagttcagaaacataaagagaaatttcttgtaactcaagtggcctaattcctggccaaccagcagaagaaataccagtatgaagaattcaaagacctcataaaatctatgctgagggatgagctgcaattcaaggacgagaagcttgcagagcagcttgggcaagctgaggagctcaggcaatataaagtcctagttcactctcaggcacgagagctggcctggttaaggaagagattacaggaagggagagatgcctcccgctcattgaatcagcatctccaggccctcctcactccggatgagcctgacaactcccaggggcaggatatctgagagcagctggctgagggctgcaggctgacagagaacctcatccacaaactcagcccaggtaaggtggccaca

SEQ ID NO: 51050 - DNA, 2372 bp, Homo sapiens
gttctctgggaccaccttcttttggcttcaacctctcccactcttgacatctgagtagctcagggaagctcttccaggtccgactgttcatatgtaaaggagactggccgctggggctcaggaccgggattatccgagctctgcagaagtgcaccgctattgctttgggagggtaaaaaaaaaaaatcacacggtttccagtgaaaaagtgacagagggtggtggcctttggaaccgccgtgaagtcttctgcctggaacccgaaacttgcatgctatggaacacccgctctttggctgcctgcgcagccctcacgccacggcgcaaggcttgcacccgttctcccaatcctctctcgccctccatggaagatctgaccatatgtcttaccccgagctctctacttcttcctcatcttgcataatcgcgggataccccaacgaagagggcatgtttgccagccagcatcacagggggcaccaccaaccaccaccaccaccaccatcaccaccatcagcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtgatggcaagccttacccaaatatcgtttacacagagagatgactatggcagtgatgtttaatattattaaatccaggcatttcgaatctgtttttcatgatttatagagggtttacacaaagtgccacttattaaagagcttccacagtgaagatggagaaggtgaacttgctttgaatattccagatgtgtttggtcatgcgtatggcagtgagcaggtatgtgtttgcttttgcttgcactgaaaattaaattgctatcaagagcaaactatgaacggttttttattcaagatgtctccagagtgaagatgccgaggatgaacttgcattgaacattccagatgtgtgagatcatgtgtattacagtgggcaggtatttgcttttgcttgcactgaaaattaaattgctatcaagaataaaccatgaaacattttatcctgaacagccacagtgcctgaattcactcaagtggataaaaagtgtattttaactctgtatatattacccttaagtcattttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattcttgtaccacagacaaaacaaatcttatgttgcatttactatcaactgctgctaatacgttattataaaacttacctagctcctgaattcttcctatcttatagcttaaaaaaattaggatcataggcaaatcagttaccttgcagaaagagctttgtatgacagacattgtcttattttatttctgtaaaatattagctgtatgaatatgatttaattaacaagaaaacatttcttcctgattgacaacagtgttagacaaggtgcaaagcgaaactggttgctcaagttgatagaaaacaaaattctgaatatcttcaaattaaattcggtaaaaacacattattttttcatatgtgatgtattcatgcagaacaactatctttgtattttgtttttaaaatgtgtttaataaatgatcctttgtaaataaaatttggt

SEQ ID NO: 51051 - DNA, 1997 bp, Homo sapiens
gttctctgggaccaccttcttttggcttcaacctctcccactcttgacatctgagtagctcagggaagctcttccaggtccgactgttcatatgtaaaggagactggccgctggggctcaggaccgggattatccgagctctcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtgatggcaagccttacccaaatatcgtttacacagagagatgactatggcagtgatgtttaatattattaaatccaggcatttcgaatctgtttttcatgatttatagagggtttacacaaagtgccacttattaaagagcttccacagtgaagatggagaaggtgaacttgctttgaatattccagatgtgtttggtcatgcgtatggcagtgagcaggtatgtgtttgcttttgcttgcactgaaaattaaattgctatcaagagcaaactatgaacggttttttattcaagatgtctccagagtgaagatgccgaggatgaacttgcattgaacattccagatgtgtgagatcatgtgtattacagtgggcaggtatttgcttttgcttgcactgaaaattaaattgctatcaagaataaaccatgaaacattttatcctgaacagccacagtgcctgaattcactcaagtggataaaaagtgtattttaactctgtatatattacccttaagtcattttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattcttgtaccacagacaaaacaaatcttatgttgcatttactatcaactgctgctaatacgttattataaaacttacctagctcctgaattcttcctatcttatagcttaaaaaaattaggatcataggcaaatcagttaccttgcagaaagagctttgtatgacagacattgtcttattttatttctgtaaaatattagctgtatgaatatgatttaattaacaagaaaacatttcttcctgattgacaacagtgttagacaaggtgcaaagcgaaactggttgctcaagttgatagaaaacaaaattctgaatatcttcaaattaaattcggtaaaaacacattattttttcatatgtgatgtattcatgcagaacaactatctttgtattttgtttttaaaatgtgtttaataaatgatcctttgtaaataaaatttggt

SEQ ID NO: 51052 - DNA, 1157 bp, Homo sapiens
ctccttcagaggagaagggccagggagaggtcagagacatctttctgcttctgttttctcaaatgccaaggtgtcatattttgaggtagcatgtcccgtataccccaatggccatatatactagtatcttgttaaatgactactgtgtttcattaatttagaactatagttaggaggagttacatattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgacataaaaaatcctcagtgttaaacatcttcctgtgttataataattcctcttttttttaacattgtaggcaagttaggagcgggtgaagtggatatataagtcatagatatgttcatgttcttactgaaagcaatttaaaaattccgaagcagattgcaaaaaaaatgtattaaaagcttatgcggctgggcgtggaggctcacgtctgtaatcccagcactttgagagtctgaggcaggcagatcacttgaggttgggagttcggaaccagcctgacatggagaaaccttgtctctattaaaaatacaaaaaaattagcagcttgtggtggcgcatgcctgtgatcccaactactcaggaggctgaggcaggagaataacttgaacccaggagacggaggttgttgtgagccgagatcgcgccattgcactccagcctgggcaacgagcgagactccgtctcaaaaaaaaaaaaaaaaaaagagagaaaagcttatgcaacacacatgtgaacaagacacaacgagaaactgctagcaatccttttactacaaaggtctgactctggcctttagaaagcatttggggagttcccacccagctgtgctcacatttccacatcaaggaattcccaagcatatataatttgtgttttctactcgaacatatgaatttatgatggattatccagtttttttgttttaaacattgtcagtgattgttccccctgtagcaacagccagacatcagtgtagttgctcctactagagtattatagtggttcagggaaaataaaaacattacctaagcttgga

SEQ ID NO: 51053 - DNA, 398 bp, Homo sapiens
ttaattccttggcttcaaaaaaaaaaaaaaaaaatcatgtgtgggattttaccctctctgaaaatgcccttagaatagccaactaccgttacaaaatccaaaaagaggggcagagagggaaagaaacacaacttaaatctcagaaggaaaaattccatggaattagagagtagttattctataaatgtactaggttttattgagttttgagaagaatatgttggcataaaaataaacattttcagttatgggcattgacagatactgtgttttaagaaaaacagttggctcattcactgaaatttggactatcaagagttcacatcacaagatgtgcagctgaagactttaaaccatgggaaagttttacgttaaggaattaaaaaaataaataaaat

SEQ ID NO: 51054 - DNA, 519 bp, Homo sapiens
caagcttgaaacatgcacttttaaatcaataccagaaaagaacaacgaaaatagtggcttgctttgttggcccttcctttgtactgggctctgtgcagggcatgtcacctgagctgtcactgtgtttagtaccagccccccccttaataggtgtggacgtcttcctgaacagcctgaagcagacggtggtgaccctggcaagcagcgcagacgtgctgagcaccgagcagtcggcctcccaggccatgctgcagagcggctggtccatgctgttgcccaccgctgagaagcaggcccgggcactctgctctcctgccctgcggagtttcaggcaatgaagtgagcataagtccaggtcatcgattggtgattgatcttctggtgggcagcttgatggctgctggagggttggagtcagccttacacgcagccattactgcagagatccaggtatggccttggaggcacacgtgacctggtggtgggctgagatcggaatggggcatgggtcgagcttcg

SEQ ID NO: 51055 - DNA, 826 bp, Homo sapiens
aggcatgctgaggtgagggctggtgcagaccgggaatgctttggggaagcgcctctgtatccaaatacctgttgcattgtgtgcgtttcactgaatcgtgtgactgcagcaggtgtggtgctctacagagaaccatgtcccagggctctctcttttccttttcttcacttcctgttttatgctcagttttctagcctgggaactgttcttctttttttttctttcagttttcctcatttaattatttttattccatgaatttaagaccctagatcttcatgtaaatgtgctctttgagcttcttaactggtctttcctatcagcagaaggcgatgtcttgtgctaaaatctcagtgtcaattcagtgatttaactaccacggctttactttcgtttcctttcatatcccaagtatttcttcacttctatctagctgtttgcttttatttttgatcaaccatgaaaaaaaaaaaagttaatctgtttttactaggaataaatatgttttcttctttagccaaatgttgtctgccatcctgttgttgcttcagctgtgggacagcggggcacaggagactgacaatgagcgttccgcccagggcaccagcgccccgcttttgcccttgctgcaaaggttccagagcatcatttgcaggaaggatgcaccccactccgagggcgacatgcacgtgagtgtcatgatggaactttgtgtttaggtggcactcgagtctagttattttttacgcaagaccagcgtgcttgtgcatggcagtgtttttctctggtgtctgtgtgtttggtggtaacagcagcgagtcagatg

SEQ ID NO: 51056 - DNA, 1752 bp, Homo sapiens
  misc_feature (1365)..(1365): n is a, c, g, or t
  misc_feature (1375)..(1375): n is a, c, g, or t
  misc_feature (1415)..(1415): n is a, c, g, or t
  misc_feature (1448)..(1448): n is a, c, g, or t
  misc_feature (1457)..(1457): n is a, c, g, or t
  misc_feature (1476)..(1476): n is a, c, g, or t
  misc_feature (1504)..(1504): n is a, c, g, or t
  misc_feature (1511)..(1511): n is a, c, g, or t
  misc_feature (1516)..(1516): n is a, c, g, or t
  misc_feature (1668)..(1669): n is a, c, g, or t
aggcatgctgaggtgagggctggtgcagaccgggaatgctttggggaagcgcctctgtatccaaatacctgttgcattgtgtgcgtttcactgaatcgtgtgactgcagcaggtgtggtgctctacagagaaccatgtcccagggctctctcttttccttttcttcacttcctgttttatgctcagttttctagcctgggaactgttcttctttttttttctttcagttttcctcatttaattatttttattccatgaatttaagaccctagatcttcatgtaaatgtgctctttgagcttcttaactggtctttcctatcagcagaaggcgatgtcttgtgctaaaatctcagtgtcaattcagtgatttaactaccacggctttactttcgtttcctttcatatcccaagtatttcttcacttctatctagctgtttgcttttatttttgatcaaccatgaaaaaaaaaaaagttaatctgtttttactaggaataaatatgttttcttctttagccaaatgttgtctgccatcctgttgttgcttcagctgtgggacagcggggcacaggagactgacaatgagcgttccgcccagggcaccagcgccccgcttttgcccttgctgcaaaggttccagagcatcatttgcaggaaggatgcaccccactccgagggcgacatgcacgtgtggacgtcttcctgaacagcctgaagcagacggtggtgaccctggcaagcagcgcagacgtgctgagcaccgagcagtcggcctcccaggccatgctgcagagcggctggtccatgctgttgcccaccgctgagaagcaggcccgggcactctgctctcctgccctgcggagtttcaggcaatgaagtgagcataagtccaggtcatcgattggtgattgatcttctggtgggcagcttgatggctgctggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttttgtgctaattttaaaaattactgagatgatttaattgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgcttngccttggagnatgattttcagattcgctcactgttgtgtgtattgcgacntcgtttttattattgggaagttttccattttanaggtgtagnactgtttgttagttcattntcctattgaaggacatgtaattgttttnggttttngtttnctttttttttttttttttttttttttgagacagggtcttgctctgtcacccaggctgtatacagtgacctgatgttggctcactgcagccttgtactcctaggctcaaatgatcctcccacctcagcctcctgtgttgcagggaccacatanntgtcaccatgtccggctagttttttgatttttttgtagagacaaggtttcactgtgttgcaaggctggtcttcaactcctggg

SEQ ID NO: 51057 - DNA, 1213 bp, Homo sapiens
  misc_feature (826)..(826): n is a, c, g, or t
  misc_feature (836)..(836): n is a, c, g, or t
  misc_feature (876)..(876): n is a, c, g, or t
  misc_feature (909)..(909): n is a, c, g, or t
  misc_feature (918)..(918): n is a, c, g, or t
  misc_feature (937)..(937): n is a, c, g, or t
  misc_feature (965)..(965): n is a, c, g, or t
  misc_feature (972)..(972): n is a, c, g, or t
  misc_feature (977)..(977): n is a, c, g, or t
  misc_feature (1129)..(1130): n is a, c, g, or t
caagcttgaaacatgcacttttaaatcaataccagaaaagaacaacgaaaatagtggcttgctttgttggcccttcctttgtactgggctctgtgcagggcatgtcacctgagctgtcactgtgtttagtaccagccccccccttaataggtgtggacgtcttcctgaacagcctgaagcagacggtggtgaccctggcaagcagcgcagacgtgctgagcaccgagcagtcggcctcccaggccatgctgcagagcggctggtccatgctgttgcccaccgctgagaagcaggcccgggcactctgctctcctgccctgcggagtttcaggcaatgaagtgagcataagtccaggtcatcgattggtgattgatcttctggtgggcagcttgatggctgctggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttttgtgctaattttaaaaattactgagatgatttaattgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgcttngccttggagnatgattttcagattcgctcactgttgtgtgtattgcgacntcgtttttattattgggaagttttccattttanaggtgtagnactgtttgttagttcattntcctattgaaggacatgtaattgttttnggttttngtttnctttttttttttttttttttttttttgagacagggtcttgctctgtcacccaggctgtatacagtgacctgatgttggctcactgcagccttgtactcctaggctcaaatgatcctcccacctcagcctcctgtgttgcagggaccacatanntgtcaccatgtccggctagttttttgatttttttgtagagacaaggtttcactgtgttgcaaggctggtcttcaactcctggg

SEQ ID NO: 51058 - DNA, 1730 bp, Homo sapiens
  misc_feature (1343)..(1343): n is a, c, g, or t
  misc_feature (1353)..(1353): n is a, c, g, or t
  misc_feature (1393)..(1393): n is a, c, g, or t
  misc_feature (1426)..(1426): n is a, c, g, or t
  misc_feature (1435)..(1435): n is a, c, g, or t
  misc_feature (1454)..(1454): n is a, c, g, or t
  misc_feature (1482)..(1482): n is a, c, g, or t
  misc_feature (1489)..(1489): n is a, c, g, or t
  misc_feature (1494)..(1494): n is a, c, g, or t
  misc_feature (1646)..(1647): n is a, c, g, or t
aggcatgctgaggtgagggctggtgcagaccgggaatgctttggggaagcgcctctgtatccaaatacctgttgcattgtgtgcgtttcactgaatcgtgtgactgcagcaggtgtggtgctctacagagaaccatgtcccagggctctctcttttccttttcttcacttcctgttttatgctcagttttctagcctgggaactgttcttctttttttttctttcagttttcctcatttaattatttttattccatgaatttaagaccctagatcttcatgtaaatgtgctctttgagcttcttaactggtctttcctatcagcagaaggcgatgtcttgtgctaaaatctcagtgtcaattcagtgatttaactaccacggctttactttcgtttcctttcatatcccaagtatttcttcacttctatctagctgtttgcttttatttttgatcaaccatgaaaaaaaaaaaagttaatctgtttttactaggaataaatatgttttcttctttagccaaatgttgtctgccatcctgttgttgcttcagctgtgggacagcggggcacaggagactgacaatgagcgttccgcccagggcaccagcgccccgcttttgcccttgctgcaaaggttccagagcatcatttgcaggaaggatgcaccccactccgagggcgacatgcaccctgaagcagacggtggtgaccctggcaagcagcgcagacgtgctgagcaccgagcagtcggcctcccaggccatgctgcagagcggctggtccatgctgttgcccaccgctgagaagcaggcccgggcactctgctctcctgccctgcggagtttcaggcaatgaagtgagcataagtccaggtcatcgattggtgattgatcttctggtgggcagcttgatggctgctggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttttgtgctaattttaaaaattactgagatgatttaattgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgcttngccttggagnatgattttcagattcgctcactgttgtgtgtattgcgacntcgtttttattattgggaagttttccattttanaggtgtagnactgtttgttagttcattntcctattgaaggacatgtaattgttttnggttttngtttnctttttttttttttttttttttttttgagacagggtcttgctctgtcacccaggctgtatacagtgacctgatgttggctcactgcagccttgtactcctaggctcaaatgatcctcccacctcagcctcctgtgttgcagggaccacatanntgtcaccatgtccggctagttttttgatttttttgtagagacaaggtttcactgtgttgcaaggctggtcttcaactcctggg

SEQ ID NO: 51059 - DNA, 1729 bp, Homo sapiens
ctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaattggaatttccgaaaatctgtactccaccatgagctttattgttggggatattaacaaatgtgatttgtataatgaaatgcatttcatttggaagaattcaatgaaccatttttccaagtgaccagtacgtgatgttacaaaatcatgcatggctcaaagattgattcaaaagtgtaagacaggccagtggattttaatgtattaacaatataagagtgcattaagttttcggagtctacattgcctttaagaaactatgacttgtagtaagccgggcgcggtggctcacgcctgtaatcccaacactttgggaggccaaggtgggtggatcacaaggtcaggagttcaagaccagcctggccaatatggtgaaagtccgtctctactaaaattacaaaaattagccgggcgtggtggcagatcccttgtagtcccagctactcgggaggctgaggcaggagaatagcttgaacccgggaggtggaggttgcagtgagtcgagatcgtgccactggactccagcctgggtgacagagcgagactccatttcaaaaaaaaaaaaaaaaaaaaaaatcacttgtagtcttggtgtggtatcaaagaatagccacaattagctgaaaaggctattttaaaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggcaacctcca

SEQ ID NO: 51060 - DNA, 967 bp, Homo sapiens
ctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaattggaatttccgaaaatctgtactccaccatgagctttattgttggggatattaacaaatgtgatttgtataatgaaatgcatttcatttggaagaattcaatgaaccatttttccaagtgaccagtacgtgatgttacaaaatcatgcatggctcaaagattgattcaaaagtgtaagacagccccctgtatatctacactagttccggcttagcggattaccaggttactctggaacagctctgccctatc

SEQ ID NO: 51061 - DNA, 247 bp, Homo sapiens
gggcagagctttcccagtaagtcccagttcccgtgggcactggggagacaggaaaggagagctgttgagctttctgtctcagaagaaaggtgttttttcccccaattaaaaacatttttttttttttttttagacctgggcaacatggctaaactctgtctctattaagaaaaaaaatgttaacattatgatttaaaagtgcattaaccttaatctagataataaaagctttttggggcaacctcca

SEQ ID NO: 51062 - DNA, 1763 bp, Homo sapiens
ctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaattggaatttccgaaaatctgtactccaccatgagctttattgttggggatattaacaaatgtgatttgtataatgaaatgcatttcatttggaagaattcaatgaaccatttttccaagtgaccagtacgtgatgttacaaaatcatgcatggctcaaagattgattcaaaagtgtaagacaggccagtggattttaatgtattaacaatataagagtgcattaagttttcggagtctacattgcctttaagaaactatgacttgtagtaagccgggcgcggtggctcacgcctgtaatcccaacactttgggaggccaaggtgggtggatcacaaggtcaggagttcaagaccagcctggccaatatggtgaaagtccgtctctactaaaattacaaaaattagccgggcgtggtggcagatcccttgtagtcccagctactcgggaggctgaggcaggagaatagcttgaacccgggaggtggaggttgcagtgagtcgagatcgtgccactggactccagcctgggtgacagagcgagactccatttcaaaaaaaaaaaaaaaaaaaaaaatcacttgtagtcttggtgtggtatcaaagaatagccacaattagctgaaaaggctattttaaaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggcaacctccagaactgtgaaaaataaatttgttatttaaaaaga

SEQ ID NO: 51063 - DNA, 1675 bp, Homo sapiens
ctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaattggaatttccgaaaatctgtactccaccatgagctttattgttggggatattaacaaatgtgatttgtataatgaaatgcatttcatttggaagaattcaatgaaccatttttccaagtgaccagtacgtgatgttacaaaatcatgcatggctcaaagattgattcaaaattttcggagtctacattgcctttaagaaactatgacttgtagtaagccgggcgcggtggctcacgcctgtaatcccaacactttgggaggccaaggtgggtggatcacaaggtcaggagttcaagaccagcctggccaatatggtgaaagtccgtctctactaaaattacaaaaattagccgggcgtggtggcagatcccttgtagtcccagctactcgggaggctgaggcaggagaatagcttgaacccgggaggtggaggttgcagtgagtcgagatcgtgccactggactccagcctgggtgacagagcgagactccatttcaaaaaaaaaaaaaaaaaaaaaaatcacttgtagtcttggtgtggtatcaaagaatagccacaattagctgaaaaggctattttaaaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggcaacctcca

SEQ ID NO: 51064 - DNA, 533 bp, Homo sapiens
gaaagatttcagttaagtagaaattgtggaaacagatcgacagactgaaggggtgtccagtgtgaggatcaaaaactgaaagtgtagggagaaagaaatcacaaaagagctggagctcatgatccagtgcagctgaagagatgcccagaaggaaacagaaagcagcagcactgggcagggatattgtgccgcatttaggaaatctagataccatttgttctgtgaataggaggaaacttttcaggattcacagaacacatcttaccagcatgctgctttagtcgtctcagaagtagcatgtatggaataggcaaactctgataaaggagtatggagacgtttcttgtgttttttctttgttttgtttaaaacgacttacatttactatgttacacattctgtagggcagaattccaggcacaggttaactggatcctgcttatggtcccacatggctgaaataagtgtgttggctgagttgcaatttcatctgatgtttttccattcccccgtggttgtggtagaatccagga

SEQ ID NO: 51065 - DNA, 1314 bp, Homo sapiens
atttcaataaagctattttaaaaataaactgtaagccgggtgtggtggctcacgcctgtaatcccaaaactttggtagactgaagcatgcagattgcttgagcccaggagttcaagaccagcttgggcaacatagtgaaaccccatctttaaaaaaaaaacattaaccaggcatggtggcacacgcctgtagttccagctactcaggaggctgaggtgagaagatcagttgagcccaggaggtcaaggctgcggtgagctgttatcacaccactgccctctagcctgggtgacaacaaagcaagaccctgtctcaaaaaaacacagagactgtagttgctttaaaaatatgacttctgtatgctatgtggttacagaaaataagatcatgtcaattttttcttttttaaaatgccaaaagtttctttaaggggaaaaaaatggaactatagtaaacagactataaactatcttactgaagagtctaaaatgaagcaggtctatcaatgtaccttaacacagcttgaaataacaatcaactcttaaatgcttttggtctaagactgttgccaagtaatatggtttggatttgtgtccctacccaaatctcatgttgaactgtaatccccaatgttggaggaggggcctggtgggaagtgattgtatcatgggggtggaatccccctggctgttctcatgatagtgagctctcacgagatctggttaagtgtgtgacaactccccctcactgttctcatgatagtgagctctcacgagatctggttaagtgtgtgacaactccccttcgctgttgtcatgatagtgagctctcacgagatgtggttgtgtgacaactccccctcactgttctcatgatagtgagctctcaacaagatctggttaagtgtgtggcaactcaccctcgctgttctcatgatagtgagctctcaggagatctggttaagtgtgtggaaactcccccttgctgttctcatgaaagtgagcctcgcgagacctggttaagtgtgcagcacctcccccttgctgttctcattacagtgagctgtcacgagatctggttgtttagaagtgtgtggcacctcccactttgctgttctcatgatagtgagctctcacgagatctggttaagcatgtggcatctcccccttctctctctcttcctcctgctttggccatgtaagacatgcctccctccccttagccttccaccatgattgtgggtttcctgaggcctccccagccatgcttcctgtacagccgagccaattaaacctctttataaagtaaacagtc

SEQ ID NO: 51066 - DNA, 1511 bp, Homo sapiens
cagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccagggggccactaccagtcagttggagttggtattcaaggtggagtctggttgccgtctctgccctgttcccattatgtagtgagttcaggtacttaatacctaactgaggaccctaggactgcagtttgagatcatctggggccaggcacagtggctcacacctataatggtagcactttgggagcctgaggcgggaggatcacttgagcccaggagtttaacagtttaaaatcagcctgggcaacatgatgagacatcgtttctacaaaaaaattttttaaattagctaggcattgtgatgtgcacctgtggtccctgctacttgggagcctgaggcaggagaatcgcttgaaccttggaggttgtggctgcagtgagccctgatcgcaccactacaccccagcctgggtaacagagcaagaccctgtctcaaggaaaaaaaaaatcatctggcccatcctgttacttaacagagaaggtacctgaggctcaaaaaggatgactgacagtcctagtggcagaatggaggtgggatctggaacccacaacttgattcctaggactcttttttttttaattcccacattggctgggtgtggtggctcacgcctgtaatcccagcactttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcaggaggctgaggcagaatcgcttgaacctgggaggcggaggttgcagggagctgagatggcgccactgcactccagcctgagcgacagagtgagactccgtctcaaaaaaaaaaaaaaaatgcaaaaattagccaggcgtcgtggcgcatgtctgtaatcccagctcctcgagaggctgagtggggaggatcacttgagcccaggaggcagaggttgcaatgacctgcgatcatgccactgcactccagcctgggcaacagagactctgtttcaaaaagaaaaaaaaaatccccacattttatttaattttcagtccatacagttctattcctgctagggctgtaactccagctgaaggcaccacagctgtcacccaaggagtttctgtggccatgggaaggtgttgcattcactgctacttgagaccaccacgtgacattcctgcaggct

SEQ ID NO: 51067 - DNA, 889 bp, Homo sapiens
gtggccgatagctggtcctctttctccaacacctagcctgagacttggcggcgcggctgctatcctgaactagcttggtaagtgttgtgtcccgaaccagcgtagagagacctcggaccagccgccttgatgacagcatccgcgtcctccttttcatcatctcagggtgtccagcagccctccatctacagcttctcccaaataaccagaagcttgtttctcagcaatggtgtggccgccaacgacaaactccttctgtccagcaatcgcatcaccgccattgtcaatgcctcggtgggaagtggtcaacgtattcttcgagggcttcagtacataaaggtgcctgttaccgatgctcgtgactcgcgtctctacgacttttttgaccccattgctgatcttatccacaccatcgatatgaggcagggccgtacgctgctgcactgcatggctggagtgagccgttccgcctcactgtgccttgcgtacctcatgaaataccactccatgtcgctgctggacgcccatacatggaccaagtcgcgccgccccatcatccggcccaacaacggcttttgggaacagctcatcaattacgaattcaagctgtttaataacaacaccgtgcgcatgatcaactcgccggtaggtaacatccctgacatctatgagaaggacctacgtacgatgatatcaatgtaagccatcccggccagcccctgacatctgccatcgatcttgcaccaagactgaacttgaacactgacattttgttagtaaagaaaaccggatggtgccttgttaaagggcaagaaaaaagggagggggttggagttttgaacgtagtaagccttaccttaatagaattaaattcatgaaacataaaaaa

SEQ ID NO: 51068 - DNA, 657 bp, Homo sapiens
aaattcaggaactattgagcatcaatgtggaagttgagtgctgaggtcaaatgatgttgcttgggctaagagaacatatggctatcgtaggggggcttacatagcctagaaaaattagaagagtttctctccaatttccaaaatgccagccacacacaactttccaaccctccaaataaggctgttacagcatcctcatttacactttccaaacataacttatgacagtgatacgcctaccctgctctgtattttatttttgggaaaccttaaatgcattacaccttagaaatggtctaggtaaatttccagtttgaagatgttagtgagatttctgtaggtggctggggagtttgttctacactttggctttttccagaaggcttcaaattctaaagaatggagggaggttactttacttgggtcttatataatggtttcccagaatcctaagcctttattaatttatctgtggccaaaggaattcagaacatggtacctgacgcacttgatagcatcaatagtttttctactctgtaactatgagaaaactgtctttctctacctactgactgaactactggagacctgccgcctgaactagaagcattttcttgtactttcacttttctagaatttgataataaacctcattat

SEQ ID NO: 51069 - DNA, 489 bp, Homo sapiens
agcattatccatggccagtgattgatggacttgttcaggtcctatgcagagtgcttcatatatctcatctcaatcctctaaataaccatgaaagttgatgattatctcatggtacagatgggaggctaagagtgtttaattttccccaagttccagtgctagtaagtgttgatgtctggatctgaacctgtgttaatggtgtttctagtcgatgctgttatctgttgcaccacattttgaataatcttggactttcagagtatgaaggacgattaaatataaccctttggtataaatgttctctctctcactcctctgtaacaattggagaaacagagttctaacaatattaaaatcagccatagacagagagtagtgagaaatatactttttttaatacagaaggttccctgaagtacttttagtattattctaaattaagcaataaccaatgaacaattttggtcataagcagtttctctccagaaa

SEQ ID NO: 51070 - DNA, 287 bp, Homo sapiens
attcaacagcttaggggaaatgtacaaatttatttaaagataaaaatgaccaaatctaccccaaaaaatagaatctgtgtagtcctatctgtgttaatgaaattgaatttgtaattcccccaaattccatgtgtgttagtctgttttgtgttgctgtaaaggaatgcctgagactgggaaatttacaaagaaaagatgtttgtttgggctcggggttctgcaggctgtttaagaaggacagtgctagcattcgcttctggcgaggcctcacgaagcttatagtcagg

SEQ ID NO: 51071 - DNA, 558 bp, Homo sapiens
  misc_feature (555)..(555): n is a, c, g, or t
ggcacgaggaaaaattctctctgcatcaagaccaaagaacaaatatctcccatgaaattgccccgagtgtccaatggctgttgctatgaggtcattgtggccagccagagccctccaggctggaaggagtgtgttcgttggggtcagagccacccagggcttgggggacggaggtgatgtggaattctcccagctgttccgagagcaaacgactccaaggcagcccgaagtggctgcggagcttttgtttttcttggagccttaatttgattaacacttcaggagcagtggcagagtgtacagaaagcaaggcaccaccaccttctcccactgcccccctgcaggccaccccctgaatggagcctgggtcacagagctggggagggagcagatttggacttggaggaccctgggtgtccctggagctggttcttgaatgcatgggttcagagcgggggcctccaaaacagatctgagcatcagaaggagcaagaactgtgtctcacctgcccagcaccgccaaagccacaaaaaacaaacaaacaaacaaaaaanaaa

SEQ ID NO: 51072 - DNA, 350 bp, Homo sapiens
gaacatctttttccaacttcacattgagtaattcacttaggtagcttgaaattggccattgtgggagtatttacaccatgagaacaggcaggttgcaaaccagggttcttttttctccagagttgactgttaaacatttgttggggacggtgatagggaaggacagtagagatgtttaaatgtttatcatctagcaagacaacccactaaaatgccaatttgtgtcccaggctcgtcaaaggtttaagtgtgaggtctggtatcagattaaagaggcccacaccccagatctgtcaccttaaaagcttcataaccctaggcatactgaaacattctaagcctcagtttcc

SEQ ID NO: 51073 - DNA, 457 bp, Homo sapiens
tcccttcatgataaaactcctcaacaaactaggcacagaaagaacataccttaaaataataaaagccatatatgacaaactcacagccaacatactgaatgaggaaaaactgaaagcattcttcctaagaactggaacaagacaagaatgcccacttctgccacttttattcaacgtagtactggaagttctagctagaacagtcaggcaagagaagaaataaagggcatctaagttagaaaagagaaatcaagctatctctgtttgctgatgatgtgatcttataccttgaaaattctaaagactcctccaaaatctcctagattggataaatgaatctgtaaagtgtcaggttacaaaatcaccatacacacatcagtactactgctatataccaataatgaccaagcagaatcaaatcaagaactcagtcccatttacaattgttgcaaaaaaa

SEQ ID NO: 51074 - DNA, 302 bp, Homo sapiens
ccaaaattcatagacaaatgctactgaaatgtaatataatgcatgttttctaccagttaaaaaaagaacaagttgtgaagtgtaatgtcacttaagaatttggaattgtttttagtatgctgtaaaatttcctatggcatttttattaggaaaataatacatgtgtttattaaagctttggaataatgtcactgaaatatgctgtttattaatacttttaatttaatatttaataaataatagcaaacataattggggcaaaattgagacttttccattctaattattcttgtacattttaa

SEQ ID NO: 51075 - DNA, 2882 bp, Homo sapiens
  misc_feature (4)..(5): n is a, c, g, or t
  misc_feature (806)..(806): n is a, c, g, or t
  misc_feature (808)..(809): n is a, c, g, or t
  misc_feature (811)..(811): n is a, c, g, or t
gaannggaaaaaatcagcatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgcagtggcgcgatctcggctcactgcagtcttcacctcccagattcaagcgattttcagctaatttttgtatttttagtagagatgggatttcaccatgttggccaggctggacttgaactcctgatctcgagtgatctgcccacctcagcctcccaaagtgctggtattacagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagagaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaanannanaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaactgtagt

SEQ ID NO: 51076 - DNA, 536 bp, Homo sapiens
cagcgccagccgagccctgctgcccggggcttgttgcgaattctcagggcccccgcaggcctgggagcggcctgtgataactggtgtatctggcaggagtagcagctgccccttggcgcgactgctggagccgcgaactagagaaacacagacacgcctcatagagcaacggcgtctctcggagcgtggagcccgccaaggtaactccgggaattgagtggagtggaggctgcactgaggcccccttctggctcctctctggtcgaaaaggctcccccgctagagagagccctgctgcttttggaagccttcaggtgttagttgctttgcaccgaagctgctgactgctggggttctgcgccgattgccaggctcaagtttattttgggggctgctgagcagactttgcccttctgtgctgttatcagcttctgtcgctgtccgtccacgcccgctatatccatccactctccgttctgtctccagcaggcaactccccctaccctgccccattttctgggtcataggggtatttg

SEQ ID NO: 51077 - DNA, 2630 bp, Homo sapiens
  misc_feature (554)..(554): n is a, c, g, or t
  misc_feature (556)..(557): n is a, c, g, or t
  misc_feature (559)..(559): n is a, c, g, or t
tattagcagcatgaggacagactaatacatagggtgaaacttttgattatatatgtaaatatataaaaatagcctttccactaataagacttctttctcctcagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagagaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaanannanaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaactgtagt

SEQ ID NO: 51078 - DNA, 2933 bp, Homo sapiens
  misc_feature (857)..(857): n is a, c, g, or t
  misc_feature (859)..(860): n is a, c, g, or t
  misc_feature (862)..(862): n is a, c, g, or t
cagcgccagccgagccctgctgcccggggcttgttgcgaattctcagggcccccgcaggcctgggagcggcctgtgataactggtgtatctggcaggagtagcagctgccccttggcgcgactgctggagccgcgaactagagaaacacagacacgcctcatagagcaacggcgtctctcggagcgtggagcccgccaagctcgagctgagctttcgcttgccgtccaccactgcccacactgtcgtttgctgccatcgcagacctgctgctgacttccatccctctggatccggcaagggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaggaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaanannanaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaactgtagt

SEQ ID NO: 51079 - DNA, 759 bp, Homo sapiens
gcatctttttacactttattcttagtttgaactcctaaatttgttgacgttgaacagctttgggtattacatattccagagtattctgaatttctttagatgagcttttcggattccgaagtcagtttgacatgctgcggtttcaaacagttcaatcattagagatgcgcattaaatccttacctttttgtttttattttcccattggcatggccaagagccattaaggaaatgcttttttcttttgaaaaaaatcatatcaatcatatatcagtcacatgagcatttaaaagattggtgcaaagaaacccaagatttacagtttatacaaagcaatatgcaacacaacaatattttgctctcaaaaataaagcagatcataataagacaatgtcagtaaatgtctttaataagatgtatcactgaattgtttcgaaaacttacagctgttcatggccctgggccattagaaaaccctagtttatgtatatttctttttcctacatggcttatttgaattacccaaacaagcaatgaactcaaactggcttaacaataaggaaatttattatttcacaagttatcaaagtgatttcaggtactatataatcaatagctcagtgatgacatcaaggtccaactttctattcctagttcattctgttatccttgatgtcggcttctcctctatggctgggtctttttggggtcataagatggctgctagtggcagttagagttatgtccttccctttggcc

SEQ ID NO: 51080 - DNA, 303 bp, Homo sapiens
atctttattatggaaatgaacaattatcaaaatactaactgcagtagcaaataacaagcccaagagtgtccaaaccaaaacagtcagggtgccttctactctcaagccagtcaactgggcttgtccaaactgcaacaaatggaaatttctttggaattcccccagattgagaggagagactcctgctgtcagggacccatagagagcactcacctgtctggatgcagatgtcagatttcaaagcctgttcttcctaggcaatcaggaatgcaattggggctggcagtggtgatgcagaagaga

SEQ ID NO: 51081 - DNA, 281 bp, Homo sapiens
tgggattacaggcgcccgacaccacgcccagctaatttttgtattttcagtagagatggtgtttcaccatgttgaccaggctgatctcaaactcctgacttcaggtgatccacctgccttggcctcccaaaatgctgggattacaagcgtgagccaccgcgcctggccaaaacgcatttctgttggtgtactgcaggtcagttctttgagtagtcttggactaatccagttatttctcctttctcacttttagttatcaagaataactgtaggatatgctt

SEQ ID NO: 51082 - DNA, 415 bp, Homo sapiens
ttctttgtgcatatcttacataaggactaagcccagaagactacacttgctaagaataactcaaaaaggtaggttatcatctaatatgatcctagcacagcagtaacaaaaacaattatctgacctttcacattagataagaatgtttcacaacaaatagtaccgacaagtattacactttacagtttacaaaagcccaaaatttcataaccaccctgcaaattagtaggcaagagagacatcactaatccccatttgaaagataaggaacccagtgattcctgtgcattctgtgatggcagatttaccacatctgccaaatgatgaaatactgtcataactcttacagtaatgcatctccttcaaactttagatatgaatgaagagttaaacacatttcatattgctttagctc

SEQ ID NO: 51083 - DNA, 296 bp, Homo sapiens
ctgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccagggcctgagctgggattgggcagggtcagggctcctcctctcttccagggcagatgtct

SEQ ID NO: 51084 - DNA, 516 bp, Homo sapiens
taagagcccgcggattttaaacaggaaaaagaaagggcggagcaaactctggcggatagttgtgagtaatccctggtccttggaataagtgtcgacctgagacagaaggggaactgtcagagagctgccggagaccctgaaaaaggccagagacggggacttgtggggctgacgaatggaatcacccaaggagaggtctctgactctaacaaaacaccttggggacggagctccttggctgggatacagagcagaaacaagtccgggatcttttagtgaattgctgccggcttctaaggcctggagcagatattcaacaacaaactccacggacctagaaactctccacttatcctactattgtagacggtggcttacttttagtcttccctatgctctaagcttctggtagtaggaatcgtgcctaactcactactgtatcttgtgaacctagccccgcgcctggtggcacgtcaaattctcggtaaatatttgtggattaaatgtgaaagactg

SEQ ID NO: 51085 - DNA, 625 bp, Homo sapiens
taagagcccgcggattttaaacaggaaaaagaaagggcggagcaaactctggcggatagttgtgagtaatccctggtccttggaataagtgtcgacctgagacagaaggggaactgtcagagagctgccggagaccctgaaaaaggccagagacggggacttgtggggctgacgaatggaatcacccaaggagaggtctctgactctaacaaaacaccttggggacggagctccttggctgggatacagagcagaaacaagtccgggatcttttagtgaattgctgccggcttctaaggcctggagcagatattcaacaacaaactccacggacctagaaactctccacttatcctactattgtagacggtggcttacttttagtcttccctatgctctaagcttctggtagtaggaatcgtgcctaactcactactgtatcttgtgaacctagccccgcgcctggtggcacgtcaaattctcggtaaatatttgtggattaaatgtgaaagactgcctgagtgtttaacctggattttctgagtcgctgatggagaacagtaggtagacggggaaccagcgccctctggtgggcttgtggttcgtgacgagaacatgctggaac

SEQ ID NO: 51086 - DNA, 469 bp, Homo sapiens
agtaaccattccctgacctcaaattctgaggtcatcgtatcaaagcctcctatgcactcattgttttctacttctgagaacatctgcccagcctggatggctctcttttgtataacatcccagcattgtctggctttgctcactggtcacagccagggttctcatgctcatctagtccttccctcaccttcacccatgtcaatgacttgcttaattacttaatttctgcttaattttttgatagcctgaatgaaatggtcctatcctcttcctgaatcatcctatgtaggtgctctccaaatcctggccttgtcactgggtgactggcagaaagataggaccattgacagaacagtgaggtcaagggggagctgacaagagggaaaagataagttaatttacaacacaattagtataagcagaggtgatgtttaggtggttacagataaggaactagaactctagtttg

SEQ ID NO: 51087 - DNA, 2645 bp, Homo sapiens
gctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccaggtgccgtggagcagcaggctggctttggtaggggcacccatcacccggcttgcctgtgcagtcagtgagtgcttagggcaaagagagctcccctggttccattccttctgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggcccactttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagttaca

SEQ ID NO: 51088 - DNA, 201 bp, Homo sapiens
tgatggcatggctagacttttacaactttggatcctctggcaatgcatatatctgtcaaatcagcccacactaaagcacagcaataagaggcatgggggtgagggagcgatcaggacaatcctaaaccttggcattttttccagatgagatcgggtgcagtcagggtagtatggcatgcagacatttgtgtttttttcaaa

SEQ ID NO: 51089 - DNA, 367 bp, Homo sapiens
caaacaaaacaaccaaatactctgttcttaacatttcatcgtcttccaaaacgacactttcttagcaacttcaaagtggcaactgatggtttggtaacgatataataacaaggaataactcctatattcttaagagactcagaatttcaattcttaccacatatacatctattttcttaattaaaacaaaaagtcccagataaagtgtaatgcccagaacttgaattttaatgaatgcaaatgagcccaaagtgagaataatcagctgaagttctaggatggaatatttgtcttgtatttaccttggaagccactagcttttactcaactataaaagaagcctcaggagtgaatataaaaagaaaaa

SEQ ID NO: 51090 - DNA, 242 bp, Homo sapiens
ggggacagaggactcaagagcccgagggaccccagaagagggctgtagaggtgagaaattgagggcaagtctccctgggctgggaagggcccaagctgtgatttggggtccagcactgacacaaacacgacaacagggggcgactgaggtgcagaagtggaaaaagcaggtcgggcgtggtgtaatcccagcgccttgggaggctgagggggaggactgcttgaggccaggagtttgagatc

SEQ ID NO: 51091 - DNA, 2282 bp, Homo sapiens
ccccgagtctctgcgccttcacatagttgtcacaggactaaagcaaattgatccagggggaaacactgtagaccgtgtatataaaaacactctataaactgcaatgctcaattcttagtataactattgttgttgtattgatatttattagtattggtgctcacaaaaagagtctaaattccataagtctttatattcaggctactctttatttttgaaaactcattttctatcacctttttctattttactccatattgaggcctcataaatccaattttttatttctttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagtt

SEQ ID NO: 51092 - DNA, 452 bp, Homo sapiens
gagcatggcctgtttctgggagtggtcagtgctttacttggagttagttaaactctgcatggacagagcctggtgttccttgcttcctctccagcatctaccccagcacttggcacttggcaatcaaaagacacttgtcagcgggccagtaaggctaggatatcagccccactaactatttgggagattctattcaatactgtaagataagaaaatcatagaaggactattaagaaggagaaaagattattataattgttttcaaaatctggaaggcccaagagtaagcatatcagctgataaactctaagaattaataaaggaaaaagctgatgaattataaacacataattctcatatatcttttttcatatattattctcatatatttcatatattagtattgaccacttggaaaatatgtctataaacatcttattcataacagcatc

SEQ ID NO: 51093 - DNA, 286 bp, Homo sapiens
gtaaaatactgatcctgacaagcaaaaatcactttggtacatcacataacaataaatgtgtttttattttttcatatatttatgttgagatactcagttttctgaaattattattagtgaaagtaaatcagccgtaataaggcactacagtcattttaatttatatctggactgttttctctcagatatgaaaccttaaaaatagaagtgaactttaaaactgagtccaaccttgcattctgttgaaaatagactaccaaaagttaagtgatgtgacagtgtctat

SEQ ID NO: 51094 - DNA, 510 bp, Homo sapiens
tgtgaatcacagtgacctgaacattactcaatgccttccttattaaaaacatgaaatcggtgctaagaatctacttatttcctaaggaccatacagcatgtggaaaggattaaaaaactggatgaagtattttttaatacagcaattttccaacaagggaaaaatatccccagtaaccgtttcatcccttctaccaactcggagattatgatctccattataagaaagcacttaacaaacttgagggattaaagaaacatttccctgcaatttcaaaaatctttaccaacgtatcccgcagcagtgaattaatatccaattacaattcaaaatagagagagaatgttcagatgaacctttttaaacaaggtaaataatacaaccctgattagtaggcagagcagaaaaccatcaacaaaagctcaaagcaaacagaagttatctccccttttcagcttgaaaagcaaagtaacagaaatgtttgataacagaaagcggtgtactttccca

SEQ ID NO: 51095 - DNA, 361 bp, Homo sapiens
ggttgtcaaaacttgagcccactacacttctagtagtttgccttctctggatgtatttttcacacagtaaatgaaggaaccaactataatattctaagataaatacttgagctctatatcataacttgcattcaaaaataaatctatatcctatatttctctgatccttctaaaaaatcctcagaaggagttaagtcagcattattactttcagctttagaaggacaaaattaacttttatacaagatacgtgatctatctaaaatcacacagctgatacatagctgagtcagaatttgaacccaattttttcagatttcaatttcagcagtttcttcaacactgtatctaatgctaaacc

SEQ ID NO: 51096 - DNA, 2556 bp, Homo sapiens
caggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggtacctaccaggatgggggatgggagatgcagagggctgagatggactggcccatggaagtaaaaacccacatgacatcactgttagggtatggtggagtgtgtgagtgtgtcataaatggaagtgttgtaactgtctgacgcttttgcctgtgtgtccatctgagcaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctggtgaggagctgcgaagagggaaggaaggagctactgtcatctcttgagactataaaatccctagcaatattcattgactctcaaatatatgtctgtagatcta

SEQ ID NO: 51097 - DNA, 3573 bp, Homo sapiens
caggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccaggtgggaagatggacgggctggtttgagagagatggggccttaagggtagctggggtatatagctggagcctggggcgtgtgttctttggtggatctgggccaggagtgaaaagtaatactgtcaaccttttttctttctttcaccttccacctttttctactggggctcctctcgtggccatggcaactttcacagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggtacctaccaggatgggggatgggagatgcagagggctgagatggactggcccatggaagtaaaaacccacatgacatcactgttagggtatggtggagtgtgtgagtgtgtcataaatggaagtgttgtaactgtctgacgcttttgcctgtgtgtccatctgagcaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctggtgaggagctgcgaagagggaaggaaggagctactgtcatctcttgagactataaaatccctagcaatattcattgactctcaaatatatgtctgtagatctaactttagtgttctgttcttaatatcttctcattctacatatgctccctgaacaatcccatccactctcatggcctcatctctgctttgctaaatctctgtgtccaatctcacttcttttctaagcaccagatctgtctatccagctgtctactgtacgtctccaccttgttgtcctgttggtacctcagacccaaccctgagctcatcatctccccgcggccaaaatctgctcctgtctgtcctcttagtttcaccatccagccagtcatgtaagccagaaatcttgttgacatctcattctccttcaccaatatccagtcaccatgtcttttcaatcctacctccttcatatttcttgaatctttccacttatttccatggttcagatgatctttacttggaaatctgacaaatgctcttacaaagctttctgtgatgaggctttcttctgtgtcctcttacactctctctaattggacttaacaagtcaggcttcctctagaccctgggattgctgtcctctctgccttctctatgtggctaaattctacttattatttctaaattacctaaggcagtagcttctccaggaagcctgatccataggctcggttagatatccatcctgtgctctgtacaataatctgtgataaccatgattttattattgtatgcttgcctatctgtccctttcaccacacttggagatttatgagaacagagaacagaaatttgtctcattcattttggtagacccaacaggaagtaagtgctcaataaaagtttgtagaagacaagataacaaaggaaaggagaaaaa

SEQ ID NO: 51098 - DNA, 3404 bp, Homo sapiens
caggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccaggtgggaagatggacgggctggtttgagagagatggggccttaagggtagctggggtatatagctggagcctggggcgtgtgttctttggtggatctgggccaggagtgaaaagtaatactgtcaaccttttttctttctttcaccttccacctttttctactggggctcctctcgtggccatggcaactttcacagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctggtgaggagctgcgaagagggaaggaaggagctactgtcatctcttgagactataaaatccctagcaatattcattgactctcaaatatatgtctgtagatctaactttagtgttctgttcttaatatcttctcattctacatatgctccctgaacaatcccatccactctcatggcctcatctctgctttgctaaatctctgtgtccaatctcacttcttttctaagcaccagatctgtctatccagctgtctactgtacgtctccaccttgttgtcctgttggtacctcagacccaaccctgagctcatcatctccccgcggccaaaatctgctcctgtctgtcctcttagtttcaccatccagccagtcatgtaagccagaaatcttgttgacatctcattctccttcaccaatatccagtcaccatgtcttttcaatcctacctccttcatatttcttgaatctttccacttatttccatggttcagatgatctttacttggaaatctgacaaatgctcttacaaagctttctgtgatgaggctttcttctgtgtcctcttacactctctctaattggacttaacaagtcaggcttcctctagaccctgggattgctgtcctctctgccttctctatgtggctaaattctacttattatttctaaattacctaaggcagtagcttctccaggaagcctgatccataggctcggttagatatccatcctgtgctctgtacaataatctgtgataaccatgattttattattgtatgcttgcctatctgtccctttcaccacacttggagatttatgagaacagagaacagaaatttgtctcattcattttggtagacccaacaggaagtaagtgctcaataaaagtttgtagaagacaagataacaaaggaaaggagaaaaa

SEQ ID NO: 51099 - DNA, 445 bp, Homo sapiens
ttttccaagtacagctctaggacaagtcccttagacttttattttcagctagattactgtcttatactggaggtgctgcagtaagtcccacttctgtcttgcagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctggtgaggagctgcgaagagggaaggaaggagctactgtcatctcttgagacta

SEQ ID NO: 51100 - DNA, 3030 bp, Homo sapiens
caggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctggtgaggagctgcgaagagggaaggaaggagctactgtcatctcttgagactataaaatccctagcaatattcattgactctcaaatatatgtctgtagatctaactttagtgttctgttcttaatatcttctcattctacatatgctccctgaacaatcccatccactctcatggcctcatctctgctttgctaaatctctgtgtccaatctcacttcttttctaagcaccagatctgtctatccagctgtctactgtacgtctccaccttgttgtcctgttggtacctcagacccaaccctgagctcatcatctccccgcggccaaaatctgctcctgtctgtcctcttagtttcaccatccagccagtcatgtaagccagaaatcttgttgacatctcattctccttcaccaatatccagtcaccatgtcttttcaatcctacctccttcatatttcttgaatctttccacttatttccatggttcagatgatctttacttggaaatctgacaaatgctcttacaaagctttctgtgatgaggctttcttctgtgtcctcttacactctctctaattggacttaacaagtcaggcttcctctagaccctgggattgctgtcctctctgccttctctatgtggctaaattctacttattatttctaaattacctaaggcagtagcttctccaggaagcctgatccataggctcggttagatatccatcctgtgctctgtacaataatctgtgataaccatgattttattattgtatgcttgcctatctgtccctttcaccacacttggagatttatgagaacagagaacagaaatttgtctcattcattttggtagacccaacaggaagtaagtgctcaataaaagtttgtagaagacaagataacaaaggaaaggagaaaaa

SEQ ID NO: 51101 - DNA, 2706 bp, Homo sapiens
caggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccaggtgggaagatggacgggctggtttgagagagatggggccttaagggtagctggggtatatagctggagcctggggcgtgtgttctttggtggatctgggccaggagtgaaaagtaatactgtcaaccttttttctttctttcaccttccacctttttctactggggctcctctcgtggccatggcaactttcacagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggtacctaccaggatgggggatgggagatgcagagggctgagatggactggcccatggaagtaaaaacccacatgacatcactgttagggtatggtggagtgtgtgagtgtgtcataaatggaagtgttgtaactgtctgacgcttttgcctgtgtgtccatctgagcaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctgacccagagaagagctgccagccagtgttggagactctgcgccaggccatggatggca

SEQ ID NO: 51102 - DNA, 1606 bp, Homo sapiens
gtgaggacagaccagccctcccgagcacctggcactcatgggctgaggctgacttctcctggaagaagggcccagagtggaaggaagaggcagagggtagaggtggtggctgggggctcctctgcagagtggggtggccaatggagagggctgcactcacaccgcaacataggactctctctcccttaagaaggcccccttagggtctgggctgccgcccccatcaccctaaaaccagccaaggtagctgaggccccagggcagacaatttcaccagcaggaggaggaggagtccagtgagcttggttgctcacagacagcaagggagctgtcacagaggaagctgatgaatggaccgctgtggggagactttaaagtagaacagtgataagggagggcaggatggtggggatgcagaagcagcagccagagagagacggactggggtgcagacggagtgtggaaaacgcataccttgaaatgaagcatccagcagatggggtgagtggatacagctcaggagattctcccaggaatagcagggaggcgtaaagagagacaacgtacagagatagatgaatggaaatgggtaagggaggtgttcattcacatccatctaactgcaaaatacaaaagtaagaagtcattgacatgaagcaacgacgaccaagacgttctcagatctaaaggtgaatgatctcagtcagcctggaaatgcacaaggtggaaaaataacataaaaaagccataagaccttgaagaacatcaatgtcaaagataaattctaaagtcccagagaaaaaagaatgggaatcaaattgacctcagactatacgtgagaaacacggagagccagaaaactgtgatgttccatcctcagagtttgaaggaaatatttgaaggctgaattttacatccagctaaactatcaaaggcatgcaaagtccatgttattcttaggccttcaaggcctcggccatttttctacagaaaagcctgattttaaaatgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatcccatgtatcaaaacatcactgtgtatccgatgaatatctacaattattgtcaattaaaaacatcattaaaaacagactagactgcattaaaaata

SEQ ID NO: 51103 - DNA, 1120 bp, Homo sapiens
  misc_feature (15)..(15): n is a, c, g, or t
gtcatcgagctcggnccagttgacggagactctctttattctcccaggaatagcagggaggcgtaaagagagacaacgtacagagatagatgaatggaaatgggtaagggaggtgttcattcacatccatctaactgcaaaatacaaaagtaagaagtcattgacatgaagcaacgacgaccaagacgttctcagatctaaaggtgaatgatctcagtcagcctggaaatgcacaaggtggaaaaataacataaaaaagccataagaccttgaagaacatcaatgtcaaagataaattctaaagtcccagagaaaaaagaatgggaatcaaattgacctcagactatacgtgagaaacacggagagccagaaaactgtgatgttccatcctcagagtttgaaggaaatatttgaaggctgaattttacatccagctaaactatcaaaggcatgcaaagtccatgttattcttaggccttcaaggcctcggccatttttctacagaaaagcctgattttaaaatgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatcccatgtatcaaaacatcactgtgtatccgatgaatatctacaattattgtcaattaaaaacatcattaaaaacagactagactgcattaaaaata

SEQ ID NO: 51104 - DNA, 4045 bp, Homo sapiens
gtcgcctctcacccgccccggccgctccagcccgaggcgccccgaccccgcgccactccgcgcccggccagccgcccgcagccatggggctcctgcccaagctcggcgtgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctatcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaaaccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaatggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacgtgatagatgttgagagacagaagccaacgaaggaggtcattcatcaacaaatatgtttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctgactatccatgccatccatggcccccagactgactctgcacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaagagtacacttggtcatg

SEQ ID NO: 51105 - DNA, 3733 bp, Homo sapiens
gtcgcctctcacccgccccggccgctccagcccgaggcgccccgaccccgcgccactccgcgcccggccagccgcccgcagccatggggctcctgcccaagctcggcgtgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctatcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaaaccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaatggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaagagtacacttggtcatg

SEQ ID NO: 51106 - DNA, 3456 bp, Homo sapiens
gtcgcctctcacccgccccggccgctccagcccgaggcgccccgaccccgcgccactccgcgcccggccagccgcccgcagccatggggctcctgcccaagctcggcgtgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctatcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaaaccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaatggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaagagtacacttggtcatg

SEQ ID NO: 51107 - DNA, 2329 bp, Homo sapiens
tctggtgaaagagaaattcaggcttcactgaaagctattctgctttccagagtcactcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaatggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacgtgatagatgttgagagacagaagccaacgaaggaggtcattcatcaacaaatatgtttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctgactatccatgccatccatggcccccagactgactctgcacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaagagtacacttggtcatg

SEQ ID NO: 51108 - DNA, 385 bp, Homo sapiens
tggtttgaatgttgttagctggggaggggtggggagtgaggccgaggggagtgtgagggcctaatcttggatgcagtccctggcccactttaatctctcttgatgtaagggttgtgtttttgtggcgattgtcgggtgtctgatttttattggtcactgtgtgctgtagtcgcccgtctgtttcctggtgggattcagatgtcctcagacctgtgcctgctgtctgtgtggtatgtaccagaattaaggagttggtatggaacacactgggaggcctaccccagaggccctgggctttctctgatgtttgtttgtttttgagacagagtcttgccctgtgtcgcccaggctggagtgcagtggtgtgatctcagctcactgcaac

SEQ ID NO: 51109 - DNA, 816 bp, Homo sapiens
gtgcctggcgcttacacatacatgataaacagttgagttagtaacagagcaggacagttggttcagcattctctaaaagtaaagcgctagaggaacaatactgttttatggagactttctggaacagttgagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcaggtacgctggagtaaatgaaatatcaggacctccccttcttattccaccattgaaagtctctgtgatatacgtcttgatgtttgttctttgacaaaacacttcatttatcactcagtttagttacctgttaaaaaaaaagactgctaaaatggtgttaaaaattttctatcaatgttttaatatcagtgctatgaattccacaaacccaattaaatgactcttgaaatttggaaccctttcatatctcgttagttatttaacaagtttttaaaaataagcctttcctggaggaatggccattagttatattgattttgtaaaccaaacttacaaaacaagcccagtgacccacaggaaaatcctatccttttcttctcaaattgttcttcccactttaagctgcttctttaagtttacaaaactcttaattttaagagttttattactcttaaaatgtaatacttttgtatgtatcaaaacagttaaatctgtctgtaa

SEQ ID NO: 51110 - DNA, 977 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcaggtacgctggagtaaatgaaatatcaggacctccccttcttattccaccattgaaagtctctgtgatatacgtcttgatgtttgttctttgacaaaacacttcatttatcactcagtttagttacctgttaaaaaaaaagactgctaaaatggtgttaaaaattttctatcaatgttttaatatcagtgctatgaattccacaaacccaattaaatgactcttgaaatttggaaccctttcatatctcgttagttatttaacaagtttttaaaaataagcctttcctggaggaatggccattagttatattgattttgtaaaccaaacttacaaaacaagcccagtgacccacaggaaaatcctatccttttcttctcaaattgttcttcccactttaagctgcttctttaagtttacaaaactcttaattttaagagttttattactcttaaaatgtaatacttttgtatgtatcaaaacagttaaatctgtctgtaa

SEQ ID NO: 51111 - DNA, 5053 bp, Homo sapiens
cggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtattgaaaaaaaaaaaaattactaaaaaaattttttggggggcttgggccttagaaaaattttttttaaacctttttttggggcgcggggcccattggttttgtgaatctgggcaaagggtggtccccggggaaatcgggcagaacaagtgttgga

SEQ ID NO: 51112 - DNA, 6307 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51113 - DNA, 5613 bp, Homo sapiens
gtgcctggcgcttacacatacatgataaacagttgagttagtaacagagcaggacagttggttcagcattctctaaaagtaaagcgctagaggaacaatactgttttatggagactttctggaacagttggcatgaggttagatgatcgagactataaataagcaaacttaatgatgtcattaataaggaagaggagaaggtacctcttggtgtcttgtttactcccactatgcatacgttctttagaaagcaaattactgaaccatatggaaaaggaaaaagctaaggtgaatgtgttgaaatgtttgatctacgtagaaaaggagaacatcaaaggcaagcctttgtatgctatgtgtgcaagaaggacaggatgaaaatcccatcagagaaaaccaaaagccaaggcaccacttcctccagctgagaccaaatatactgatgtctcttcagctgctgattctgtagaatccactgctttcatcatggaacagaaagaaaacatgatagataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51114 - DNA, 4864 bp, Homo sapiens
ccctcggttctaccatgtttcatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51115 - DNA, 5199 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccaggaaacatttaggaggaacactcttgaatctttcatctttaagtgaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcac

SEQ ID NO: 51116 - DNA, 2962 bp, Homo sapiens
gtactgtctgtgttagtctggcttggagggggctgtcttagttatctgacggatctggctagtttgctggcgttgttgcccacgtcctgactgggattctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51117 - DNA, 2721 bp, Homo sapiens
cgtcgcgacaggtatatccccctcccaagggctagtttttttgtttagaataaatagggggccattgggagggggatttcacgttaatttataccatcagtacaaaacttgtaaaattcattgctttgtggaattcactttatctttctacattctcagaggcagttttggggagccagaattacagaattaatctagctaaaaatgctctttaacagcttggtttgcagtctgtttgtgctcttgtccttggtgttgatttggtaattctgtacagattaagatgtgttaatggattatttatcttatttgttgtgaaaataacgactctctctttttaaattttatggtagaatgaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51118 - DNA, 1750 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataaggtgtgtagttttgttttctattttgtttttttggatgaggcagtgtaccatttatttttcctcttacctaacatcttttctaggtagactagtaagaagtagtcctataacagttggtaattagtaacagttactaatatgtaataagatgaatagctcattctaagattggtactaggaatagatcttctatgtacatacaggtctgtgatgcagtaaaggataaatgtccattttaagtaactttcatattcaagc

SEQ ID NO: 51119 - DNA, 698 bp, Homo sapiens
gtgcctggcgcttacacatacatgataaacagttgagttagtaacagagcaggacagttggttcagcattctctaaaagtaaagcgctagaggaacaatactgttttatggagactttctggaacagttggcatgaggttagatgatcgagactataaataagcaaacttaatgatgtcattaataaggaagaggagaaggtacctcttggtgtcttgtttactcccactatgcatacgttctttagaaagcaaattactgaaccatatggaaaaggaaaaagctaaggtgaatgtgttgaaatgtttgatctacgtagaaaaggagaacatcaaaggcaagcctttgtatgctatgtgtgcaagaaggacaggatgaaaatcccatcagtgggtacatttaaaaaataaagctttcactctacatcaaagagcagtgaatgaatttacatctgtgcatcttaagttagaatgtttgaggttatatgaacttttgatttcccactttacctgccctttttataacctgctgactagaaatattagagaattttgttatatttgcctccttttttgataatttttctaaatcattaatcctaaactattttccataagataatggtagtgtctcttctaactatatgttttaaaactctagtgatttttccaaaaaatgaacttatttaaatatgtgag

SEQ ID NO: 51120 - DNA, 513 bp, Homo sapiens
gtgagttatataaattaatagccaacactttcttacttttattatgtgccaaggacagttcttaacactttatatgtattaactcatttaatctcctgtaactcacttaatacctacctcatttatggatattatgggtactattatttttagttccattttacagatgattgtgccacagagatattaaataactcacctgaggtctcacaactactacggtaagtggtgaacctaggatttaaactggggcaatattgctctagagtgtgcccttaactaccatgtgtactacttttgttgttaaaacatagaaattatctaatttagactttggatcttaaaaatgtttcttctgtgtatctatttgcgatctgtttctctttttttccatctaacttccttggatgaaacttttctgcctgatttttcaaggcccaaatcatctaataatataaccttatttaccactgtttcccagttcccatcctcatattagcacaacttattttt

SEQ ID NO: 51121 - DNA, 957 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcaggtacgctggagtaaatgaaatatcaggacctccccttcttattccaccattgaaagtctctgtgatatacgtcttgatgtttgttctttgacaaaacacttcatttatcactcagtttagttacctgttaaaaaaaaagactgctaaaatggtgttaaaaattttctatcaatgttttaatatcagtgctatgaattccacaaacccaattaaatgactcttgaaatttgg

SEQ ID NO: 51122 - DNA, 6144 bp, Homo sapiens
cggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51123 - DNA, 6507 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccaggaaacatttaggaggaacactcttgaatctttcatctttaagtgaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51124 - DNA, 5910 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51125 - DNA, 6453 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccaggaaacatttaggaggaacactcttgaatctttcatctttaagtgaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataagggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatact

SEQ ID NO: 51126 - DNA, 4342 bp, Homo sapiens
ttccggcaccggaggccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcagggtgagtgagagagcgggctccagcgaggcccccagcgcccagccagcgcccgcaccccgcccgcgggacaggggaggtgctgagtcggccctgcccgcgctgggctgagcctcgcaggggttgccgcttctccattcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccaggaaacatttaggaggaacactcttgaatctttcatctttaagtgaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggatggataatgcatctgtaaacctgaaacgtacccattctccttgaaggcaaatgttagggcatctgccttaactttggcataaagatgttcactgatcctggcttactggactttaatccagtactaatgacttgaagcacactgtgaactacaaacatattttcattcatcatggcagatgctctttgagacttgcattgtgaggacagaagttcaattaatgtgtttcccatttgttcttctgacagatagaggccaaatgacacaatgggaagatcttcaactaagtgtcaagaaaaaaaactagtgttctagtgttctagagtcctctttgccacttaaaa

SEQ ID NO: 51127 - DNA, 1365 bp, Homo sapiens
cggacgcgtgggctgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagatatgcaaacagtggtccttgaagggctctctcaaagtcatcacaagcactcactggtgcaagattgttccgcctttgttcctctgttaccacttctgcatagctgggtggtg

SEQ ID NO: 51128 - DNA, 3520 bp, Homo sapiens
gggttgttccacatttagatgcaagtggatggggtctcgtccaaaagctctttcagtaaaaaatatattaaacccaacaatttgcttttctatgaccattctctttgtacttgagaagcaacttttcattaaaaatatgtgcatataaaagtcactctgaagataaagaaggtgggaggaaacctcttgagtgttttgggttcagcagttttatttcctgatacactgcgtttttggccctctgtgggattttacacccatgagttattacctcacataagcacattgttcatgtgagtaaacaaattgtttgcacattgtataaacaaagagcattgtttatacgatttcatttttccaaagtcagaggaagcgatgagttaacttttttgtagaaggatgaaaggggtgctttacaaaagaagatgattgctatgaagatattctacgttgtgtatttaggtcttaattaagtactactaaagtactgagtaaaagtcttcattcactgataaaattttactgttaatttttgtgaaataggggactattcagacatgcctttataaagcttgttaatctagtaattaaatatcaggtactgtaggtaccaacaccctttcctccccacatagcatttcacgtatgaaaagagaataattggatataatatgctaacaagctgtgtttgctctctgattacatttcttgactagtattcagaattgtagtcatttgctacattcttccgtagacctcatgaaataactctgtaaactttttttctcatttctttctagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgttttttt

SEQ ID NO: 51129 - DNA, 2586 bp, Homo sapiens
cggacgcgtgggctgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagcttgggtgagaaagggtatggggcccgcaagatgaggggtggccttcttttgatatattggaattggagtcccccggaagggaggctttttcgactctccc

SEQ ID NO: 51130 - DNA, 4127 bp, Homo sapiens
cggacgcgtgggctgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgttttttt

SEQ ID NO: 51131 - DNA, 4157 bp, Homo sapiens
cggacgcgtgggctgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgttttttttatacaaaacagaaaaaaacaaagtcgacg

SEQ ID NO: 51132 - DNA, 1696 bp, Homo sapiens
gaatgagttactctccactggtgattaggtaatactgtagaatgaagagttgtataatatattcatttacagctgtggattgtggtaaggactatgtccacagtgatattccaaagaattgggtttatatttgtgcttcatctgttaatcccaggtgtcctcatgttgctgaaatatttagatagctaaaatatcccttaatttcacagatgaccaggaagaaattaaccaaggttttattgactgccatgtatgtcccatgatgcatttctgagcaaatgcttatcctagagaataactctgtatgaataaaattgcttaattgagtctcttactaaataagtaactagtgccatgcttttgtgagctcttggtatggcccatattactttgttttttgtttttgttattgttgttttgtgatagtcttgctctgtcgcccaggctgcagtgcagtggcacaatctcagctcactgcaacctctgcctcctgggttcaagcaattctcctgtctcagcctcctgggtagctgggactacaggtgcatgccaccatgcctggctaacttttgtatttttagtagagacagggtttcaccacgttggtcaggctggtctcgaattcctaacctcaggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttattctattgaagttatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggttgacactgaaaaaaaaacaaaacactgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatcttttaaaaaaaaaaa

SEQ ID NO: 51133 - DNA, 1642 bp, Homo sapiens
gaatgagttactctccactggtgattaggtaatactgtagaatgaagagttgtataatatattcatttacagctgtggattgtggtaaggactatgtccacagtgatattccaaagaattgggtttatatttgtgcttcatctgttaatcccaggtgtcctcatgttgctgaaatatttagatagctaaaatatcccttaatttcacagatgaccaggaagaaattaaccaaggttttattgactgccatgtatgtcccatgatgcatttctgagcaaatgcttatcctagagaataactctgtatgaatgagctcttggtatggcccatattactttgttttttgtttttgttattgttgttttgtgatagtcttgctctgtcgcccaggctgcagtgcagtggcacaatctcagctcactgcaacctctgcctcctgggttcaagcaattctcctgtctcagcctcctgggtagctgggactacaggtgcatgccaccatgcctggctaacttttgtatttttagtagagacagggtttcaccacgttggtcaggctggtctcgaattcctaacctcaggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttattctattgaagttatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggttgacactgaaaaaaaaacaaaacactgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatcttttaaaaaaaaaaa

SEQ ID NO: 51134 - DNA, 474 bp, Homo sapiens
gaatgagttactctccactggtgattaggtaatactgtagaatgaagagttgtataatatattcatttacagctgtggattgtggtaaggactatgtccacagtgatattccaaagaattgggtttatatttgtgcttcatctgttaatcccaggtgtcctcatgttgctgaaatatttagatagctaaaatatcccttaatttcacagatgaccaggaagaaattaaccaaggttttattgactgccatgtatgtcccatgatgcatttctgagcaaatgcttatcctagagaataactctgtatgaataaaattgcttaattgagtctcttactaaataagtaactagtgccatgcttttgtgagctcttggtatggcccatattactttgttttttgtttttgttattgcagtgagccaagatcgcgcaactgcactcaagcctgggtgataaagctagactcagtgtcca

SEQ ID NO: 51135 - DNA, 427 bp, Homo sapiens
acccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactcttttgcgtatggctcctattgcactcaaaatgtttttgagattcatccatgttgttttgtgtgtcaaaagtttgttcctttagccattccatggaatgaatgtatcacattcttgtattgatagatatttgaatgtatatttgaatgtatattgatagatatttgaatacaagaatgtatccattcttgtattgatagatatttgaatgtttccagtttttcctattacgaataaaactgctatggacattcttgtatatatcatt

SEQ ID NO: 51136 - DNA, 560 bp, Homo sapiens
cggcacgaggaaataaaataaaataagccttgacctcccaggctcaggtgatcctcccatgtcagcctctccggtagctggcactacaggtgcacaccaccacacccagctaatttttgtattttcttgtagagaagggctcccaccatgattcccaggctggtcccgaacccctgggaaggagggctaaagctatccaccctcctcttcctcccaaagtgttgtgattacagttgtaagctactgtgcctggccaagaaaacaatttttaaagaggctaggtaattcaaagtcacacagttaataatggtgcagtgagaaatgaaaatgctcactctgtggcttcagagcttacactctcctacttttatggagtacactaaattaggaaccagataaaacttgtcatcttacaaatcctcctcataaaccttatctgtaatatcaggagaagaatacctactttgtatagttattgtgatgaataagtgatttttaaaaatatttagcacagcctggtacacagtgtattttcaagatatgatagtttaaaaaaaaaa

SEQ ID NO: 51137 - DNA, 371 bp, Homo sapiens
gtaaacctcctttttgatgtcaaagcaccaatttataaaacactgcagatgcatatagagattatacgtaacagatctgtccagtttgtgcacgaaatggatttgataaagtttttgctatgttattttactacatttggagattaataagtgatttatatgtatgtttttctgtaaatctacttttttgtacaagatgttctacaagatatgaagctaagggaggaaaacgccaaagatatctctagttatgttgaacatagccaacatggtttcaatgggtcagtaagaaaaaagccatttcagtaaggaatgaaataagtacttatttatgaaaatgtttcttaacaataaaaaagtatatattttta

SEQ ID NO: 51138 - DNA, 403 bp, Homo sapiens
caagtagttgggattaccggcacctgccaccatgcccggctaatttttgtattttttagtagagacggggtttcaacatgttggcaggctggtctcaaagtcctgacctcaggtgatccacccgcctcggcctcccagagtgctgggattacaggcatgagccactgcgcctggcctagtatatgtatgttttaaggatattgattcattctgccaaaattctcttcagagaaccattgtgtaactggttcttttcatcaagaggctgcttggtttctgttgtttgttttatttttgttttgtgaagactgcagttaacagggatcaggaactctgaaaagggttggctagaagagtctttacctgagcaatgtggaaatgatactgggaaagaaaataaaca

SEQ ID NO: 51139 - DNA, 222 bp, Homo sapiens
tcccaaggtgctaggattacaggcgtgagccaccatgtccagccagtaaccaccattctttatcactgaccagcatttaatgcccaggtcccctcccttctgtccctgggctttcaggccatcactaatggctcctcctcctatgcttgtggctgcctctccttccgcagcttctctttctctacttattcctgttctgcctcctcattctgggtgatccca

SEQ ID NO: 51140 - DNA, 447 bp, Homo sapiens
ggttaattcataaatgtactcattgttctccctagctattgacttcaaaggtcctcattccttatctaaatacatacatgtgctgaaaggtaaacagacaaatttgttgtttctcctaattaataaaagttggcacaatattatctgaaccaaatgtttgcgcttcctttaaaaaacatactcaagacatagcagaataaatcgaataaaaaaaaaggttaaatttgggctgggcgtggtggctcatgcctgtaatcctattacgctttgggaggccaaggtgggcagatctcttgagcctaggagtttgagacctgcctggaaacccaatctctaaaaaaatgcaaaaattagccaggcatggtggtgcatgcctgtaatcccagctactcgctcgggaagttgaggtgggaggatcgcctgagcgaagtcgaagctgcggtgagc

SEQ ID NO: 51141 - DNA, 186 bp, Homo sapiens
cttttctattaataatgtgttgctgctggttctttagctacacgaggggactacaaaatgatagtttttgtcagccatgaaaaaaatcaaacctcaaacaaaatgttataagctgtttttatatatcttaagccctgccagctaatgtgatagggcacaagggtctttgattagtctgtaagctgc

SEQ ID NO: 51142 - DNA, 374 bp, Homo sapiens
aacaaataaaatactgagggagggagagttaggacactcagtagcttatggagaaggtttcatcttcggtgagttctgcaagacacatggttaaatgtggcagaggcttaaatgtgacctgaatgctcaaaaatatggctttctctctcttctgacatgggcgtgttcttggaccatcctgctttcgtctcccagtagagtcaaaggatctcattgccttcccttctttgtattgtaactcttaatactgcacctgtgatatagctgacgctaaataaatgttgaatttgaatgaaaatgcactacgttgtgtcggcagtattcaggtcaaatggtcatgatggaaattgccaataaaatatgcttcatgcata

SEQ ID NO: 51143 - DNA, 600 bp, Homo sapiens
tagtgtctttggtaaaagaaggaaggaaaaagggaagggaaaaaggaaggaaggaagggaagaaaaaagatttcagaaagtctttctctaatttttaaaaattcttttacttagcttgtgaaactcaaaagtctgtgatgagaagaatgctagctaaacttgctttgaagggctagaaccagtggtgtgtgctggagctgctggcagcagttaccgagagcagatggttaaatttccaggaagctacttggcatcacctggatggtttgaaatccaatgtggcgggagtatttgcatccatgggaaatctgcaaatgctataaatcaaaccacctccccttccccagctggtcgtttaccagcacaccactgtctccagcctgcctcttgcaagtagccagagggtaagcatgcaaggtacagctcacaccaactaaaactcacatgggattgaggtaaacttcatttactagtttatacatttacaatggaaaatattcttggcctggtcggtgcaatcccagcactttgggagggccaaggtgggagaatcgctttagcccaggagttcaagaccagcctaggcaacatagggagacc

SEQ ID NO: 51144 - DNA, 620 bp, Homo sapiens
  misc_feature (468)..(468): n is a, c, g, or t
tagtgtctttggtaaaagaaggaaggaaaaagggaagggaaaaaggaaggaaggaagggaagaaaaaagatttcagaaagtctttctctaatttttaaaaattcttttacttagcttgtgaaactcaaaagtctgtgatgagaagaatgctagctaaacttgctttgaagggctagaaccagtggtgtgtgctggagctgctggcagcagttaccgagagcagatggttaaatttccaggaagctacttggcatcacctggatggtttgaaatccaatgtggcgggagtatttgcatccatgggaaatctgcaaatgctataaatcaaaccacctccccttccccagctggtcgtttaccagcacaccactgtctccagcctgcctcttgcaagtagccagaggcttgagcccaagggttcaagaccagcccggacaacatagtgggacttcatctctacaaaaaatnaaaaaactagccagccatggtggcacatacttgagtacctgctactcaggaggctgaggtgggaggatcccttgagcccaggaggtcaaggctgcagtaagtcttgatcatgtcactgcactccagccttggtgacagagtgattccctgtc

SEQ ID NO: 51145 - DNA, 1148 bp, Homo sapiens
cttcactctcttgaaaacccacccagatcctccccgttctgacaccatggtcagctcctgttgtggctccgtgtgctctgaccagggctgcggccaagtcctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccagctgctgtgagacgacctgctgccaccctaggtgctgcatctccagctgctgccgccccagctgctgtatgtccagctgctgcaagccccagtgctgccagtctgtgtgctgccagcccacctgctgccaccccagctgctgcatctccagctgctgtcgccccagctgctgtgtgtccaggtgctgcaggccccagtgctgccagtctgtgtgctgccagccaacctgctgccgtcccagctgctgcatctccagctgctgccgcccctcttgctgtgaatccagctgctgccgcccatgctgctgccgcccctgctgctgcctgcgtccagtctgtggccgagtctcctgccacaccacttgctatcgcccaacctgtgtcatctccacctgtccccgccccttgtgctgtgcctcctcttgctgctgagcccactgccctggctcacgtcccccttcaccactggcccacagatgtagacccttctactgtgctgaccattaggatacatgaagtggggttgatgtcattcaataggatggaccttatgcttccaaagagcccaccaccatttcactgactctgtgagaacattctggttcattttaaactccctcccttgctttctttttcttctggtggtggcaccaaatgtgaattaatttgtaatacactagctaagaaattattccaatcttctgatttccttattttctttatcactttaaggtacagattctccttctcagtgaggtagatattatctgcaggaccagttttgtcactgatgttgcaccctcagatccagccacccaattgtattctgtgtttctcctagggtgaatttcttatgctttgtttgcatctctgctttctaataaacttttctgcacttaag

SEQ ID NO: 51146 - DNA, 340 bp, Homo sapiens
tatgtctgcaaagcgcttgccataaactacaagtgaaatggaccatctacctctactgccttcagatggatgaagatatttgcttatgtagatattagaacactcattttaatatgtggattttgaatagagacattttcttgatgagttctaatcatctaattttaaacatttagaaatcagacacctttattgatgaaaacattatgtacctgtaatatatatatatgtacatgtaatatatatatatctatatatatgcttataagtcacaggatgtactattgctgtaatatattttgtcaactttaaagcaaaagcttagagatggttgagataa

SEQ ID NO: 51147 - DNA, 386 bp, Homo sapiens
agtctggatctgaagattacaacagggtgatctatacacccttgattcggccctccagccagatcagtgactaacacaagtctttaaaatgaatttaataggtcatcacctgtgaaaagaagggaaagtaaaaaaaataatagatatttactgcacatctcctattgttttcagtgctggtgacattgccatgaacaggatagcaccaccttctttgagagattacattctattgggacagatcataaacgcaggagcataacaataagatcatttcagagagtgttagttcttcctaggaagtaagagagggtaatgaatggacagtgactgggagttggaccatcagaatgtccttgtgagatggcatttgacctgaatggcag

SEQ ID NO: 51148 - DNA, 495 bp, Homo sapiens
tgatgatatagtgtattcttgaaaaacataaagagagtgcatcttatgtgctcttaccacaaaaatgataactatatgaggtaatgcatttgttaattagctagatttaaccactccacaatttatatgtatgtcaaaacatcatgttgtatatgataaaaacatacaatgttatctgtcaaattaaataaattcaaatacacttatccattgactcagcagtcttaccctatagatgtatttgcacatatatacatgggtgcacacacacagacagatgtttattatagaattctttgtaattttttaaaaactcaaaacaatcttcaacaggattttataaaacaagctatgacatatttgtacactgaaatatcatatagccatttaaaaaatacaagtactgacataggaagatagccacaatattagacaattacatcttcagagcttttttgctacatgatagaatgcaactcaaactttagcaaaaaa

SEQ ID NO: 51149 - DNA, 1638 bp, Homo sapiens
cagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcggggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgcccggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagaaaatgctaaactgaggtatggagcctccatcatcatgctcttttgtgatgattttcatattttcacacatggtatgttattgacccaataactcgccaggttacatgggtcttgagagagaattttaattactaattgtgcacgagatagttggttgtctatatgtcaaatgagttgttctcttggtatttgctctaccatctctccctagagcactctgtgtctatcccagtggataatttcccagtttactggtgatgattaggaaggttgttgatggttaggctaacctgccctggcccaaagccagacatgtacaagggctttctgtgagcaatgataagatctttgaatccaagatgcccagatgttttaccagtcacaccctatggccatggctatacttggaagttctccttgttggcacagacatagaaatgctttaaccccaaacctttatatgggggacttctagctttgtgtcttgtttcagaccatgtggaatgataaatactctttttgtgcttctgatctatcgatttcactaacatataccaagtaggtgctttgaacccctttctgtaggctcacaccttaatctcaggcccctatatagtcacactttgatttaagaaaaatggagctcttgaaatcaaaagaaaaaaatggggaattgttcacaaacaat

SEQ ID NO: 51150 - DNA, 1584 bp, Homo sapiens
cagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcggggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgcccggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagttcatattttcacacatggtatgttattgacccaataactcgccaggttacatgggtcttgagagagaattttaattactaattgtgcacgagatagttggttgtctatatgtcaaatgagttgttctcttggtatttgctctaccatctctccctagagcactctgtgtctatcccagtggataatttcccagtttactggtgatgattaggaaggttgttgatggttaggctaacctgccctggcccaaagccagacatgtacaagggctttctgtgagcaatgataagatctttgaatccaagatgcccagatgttttaccagtcacaccctatggccatggctatacttggaagttctccttgttggcacagacatagaaatgctttaaccccaaacctttatatgggggacttctagctttgtgtcttgtttcagaccatgtggaatgataaatactctttttgtgcttctgatctatcgatttcactaacatataccaagtaggtgctttgaacccctttctgtaggctcacaccttaatctcaggcccctatatagtcacactttgatttaagaaaaatggagctcttgaaatcaaaagaaaaaaatggggaattgttcacaaacaat

SEQ ID NO: 51151 - DNA, 295 bp, Homo sapiens
tgacgacctgagtgtttgctcagaatgtcttggaggtcaggagaacacagactggagaacatgcaggagggtgttgaagtcaagctaaagagagggagggggctgtctctcaaagctgcatcagattcatcacgttgtaaaagagacaaaagacagcggttctgggggtgagggcaggagagagggattactacaagagagctggatgtgtcattacctccatcatggcagtagtgtgaccaggtgtatgcacatgtcagaactcatcagattatacattttaaatgtgtacagc

SEQ ID NO: 51152 - DNA, 467 bp, Homo sapiens
gccaaaaggagcaggcagtatcttggccatccagagagacagaaaataaatgcagaccagaggagagtcttgggtttctaaagcttccgcagcaggtcaaggccaaatccatccactgtaaaatctgctgggcaacagaggcctggagtgctagtgacctgctcgcctctaattagctggggcggaggggcatcgaagtctgcaaacagcaggttgttcctgcccacactgagaatggagcgagagcaggcgcaagagctgataagtttgggtttgtgtgactcactgtacaggtcagccaattaatccttggtcatctgcctgaaaactggatggcgtccacctatgggcagtggttctgttaattggcacgttgtctcagtgatgctcccccagggcgcagcgccccgagaaagtagaacatgcacttatccataccagccagccatttcctctccataaacata

SEQ ID NO: 51153 - DNA, 464 bp, Homo sapiens
gttccttcatccactgtgtcctattcattcttcagctaactccagcaatgagctgaaactcattcatcacccttgctgagttttcttctcaatccttattcctaattctggttctagatgagccctacctacccagtggttgtatttttgtagccagtgtgggacacaggagattggcagaccaacacagctagcctctctctagccctccctccacctctaagtcactaacaatccatgtttgttcagtttgttgacatgtggcatgttcatttgttcacaacttaatcacgggggacatttcagaaaaatgtgtactaagttaaaaccatgtttagtctcctacaacttgtacattttcattttctcttatcagtagattgtccttgttgacatagctcatgcatgaggacacatagcagtacacacacattgaatgaattgttagtcatgcaaaaaaaaaa

SEQ ID NO: 51154 - DNA, 463 bp, Homo sapiens
aatcaagaaaggacacagtgatagaggaaaaaatgataaagacaaccacataggtcaagaaagggctgtttgaggaagtgatagtgtttaaactgggattagaagaataagcgctcacaagaaaagtgggttgaagagtattctaggcaaagtgaatggctgtacaatatttttttctgtaaaggaccagatagtcagtatttttgtttttctgagccatacattctcaggcacagctcctcagagtctgtttttgtagcacaaaagcagcaacagaccaaatgtaaatgaatgaacatggcagtattccagtaaaactttactttaaaaaggcagcaggctgagtgcagtggctcacgcctataatcctagcactttgggagactgaggtggcaggaacacctgaggccagcagttttgagaccagcctgagcaacatagtgagaccttgtctctacaaaaa

SEQ ID NO: 51155 - DNA, 456 bp, Homo sapiens
ggggctcaggaagtagtcttcttctgtgacggttgcgcacaggtcagggacctttatgagcagacatttcagaagtgttcctgggaacccagacaactggactgattgctgggtgggcctagaatagcatagtgcagcggatagctactctttgttaaagggaaaagctaccaattaacagccgattaaaatggtctgtattctaactcatgtttaaattccttattctgaagctacactgaactgcttactgtaggtgtttacaaatgtggagacccagctagtatttctctacttttagtttattttttgaagttttttttttttcccctctgactgttcaaaattctctgatcctggaaacaccagggtggggttcacatatctatagtgtctgtagagtgggaagatttgtgacatttgattgtatgtctctctctgtaaactactcatctg

SEQ ID NO: 51156 - DNA, 548 bp, Homo sapiens
ctaactaataacttacagatcacctcctcatattcaaacttgaaactctgaatagtcctataggctacgggaaggctgaccagtctctcggccaagagtgatttattcagcccattgacttcatgagattctgttttgatgatgagtgtacttataataacaatagctataattaattctgtgtgccaggcactttgcatatattacctcattatttttctcaacaaagttatgagatcaatattttctccatcattgtaactaagaagcttagagaagttaaatgatctgcaattatttaacttctctgagctaagcttacttagctagtaaatagctgcactgagacttgaaccccagtctttctgactccagagctcatactctttcactatgccatactgccctttattgaattaatgaggaccagctttttgtgcatgacaagaaagaagacagtaggaagggcatgagtatcagagccatggagtctagacagatggagttcctgcttctcttccatcttgttcagaacttactttctatgg

SEQ ID NO: 51157 - DNA, 561 bp, Homo sapiens
atgtaaattcatctggcatctcttgtgattttaaaacttcctaccttgtgaaaaatcctctattttgtgagaaacgggaagtccaagttaaaaatctctgatactggaaatagtagcagcttccctaagttcactacatgtgcagtgtggaaaaccaagagagagaatacaggaagttgtaagcccactgcttgtcaattcgcttggtacctctgtgtaccagacactgtgaagacaggcattggcaaatcactgaaactagctgtttaagggattctaagtgggactgggatgcagaacagcaagacaggtgcattgggtgcaagtgcctgtggatggtaacagttgagttttattcatgcaggaagtggggttgaagctgaggcctgtgggatgggcagtgaaaacaatgaaacaatgaaaggacatttcctaagatccaaggaaggaagagcaagcaagaagtcattgaaacttcaggctaacatttttgcaggacagggagctgtagtatcatttattccaatctgttgaaattagagtgggattgaaagccttaag

SEQ ID NO: 51158 - DNA, 269 bp, Homo sapiens
aaacaacaaagaatggcactggttcaaagggagctgcctcacccacattaggcatctttcccagaggcagcccatgctggtttctgttggagtacaaaagcgcagctgcattgcctccatctgggacaattctgaagggtcattgcagctccatagctccctatagggtcagctgatggcctttgttccaaccacatcacaatgtaatttttccctctgtggaatcttacttcattactcccttgtaggtggtgtttcaggggcactcc

SEQ ID NO: 51159 - DNA, 749 bp, Homo sapiens
taaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaagtcccgaagggaaaggcatggatcctgcctggtctggcagaggcaggagctagggatagaatgcatctttctttgcagcatacctgtgaaaccaggttttttctgacacctggttagtgaaatactgaaggggaggagagactctagggtttacctccaatattgctgagcaggaaaaaggccttttgcttgtggtaggtaagtaagaggaatggagctgagtaacttgataacgaggcaggaatctgctttatgatgtgaaaacattaccttttaaatgtttgtttggagcaatatcgaagtttaattttaaataatttacaa

SEQ ID NO: 51160 - DNA, 475 bp, Homo sapiens
cctttctgcctttctacagtaaagagatgctgggatatgaaagagatttgaaacaactaattccccaacttagactagaatgcactgaaatagagagagcgggggagagagggagagagagagagagagacagaaggagacagaagaaagggggaagaggagaggagagggaagaagagaacagggctagaatggaatgagttagtcaggagctaattaatgaccaaagatgaagaaaagaaagcaatgcaaaaaaatgaaaatgcagccaaggcagagcacattggataggactatacttaacagagaaatgtcttgctgttgtgcaggcttcctcaatctaaaatagcacgggtggccttcattcatggccacgatcactgaagtggctctgaagtgtctttgtacctgtaaaaatgggcttgttttgattttttgaacatacaattaaaattgttgtctttattgtaaaagc

SEQ ID NO: 51161 - DNA, 443 bp, Homo sapiens
tgtatgtataccatgcaataccactcagctaaaaaaaaaaaaaatagtcatttgcattctagatagaattggagaccattattctaagtgaagtaactcaggaataacaaacatcgttatgttctcacttataagtgggagctaagctatgaggacacaaaggcataagaatgatacagtggactttggggactcaggggaaggcgggggcaagatgaaagactacacactgggtacagtgtacattagttgggtgatgggtgcaccaaaatctcagaaaccaccactaaagagcttatccatgtaaccaaacaccaactgttccccccaaactattgaaataataataataataataataataataataataataaaagacatggttgtgttatggtgtctaggctgaattgcaatagttattcacaggtgtaatcatagtg

SEQ ID NO: 51162 - DNA, 297 bp, Homo sapiens
gcagatttggccaggaaggagccccttcaaattttcctctttggtctattgacatgtctccattgttttttttaagtccttcttagtttttgcccaagatatgttgggctcaactgtactttcctttcccaagccttggaatcagccatctttctaaagagtcctagttccttttcatagagtaaggaatatagaaaccaagattttcatgctaggtgtactcattgatactggagtgttgttatttttaggttctttcagagaataggaggaaataagagaaaagaggtagttagt

SEQ ID NO: 51163 - DNA, 565 bp, Homo sapiens
ggaaacaaggatttgaaatcttgggactagagttatagagatttattaatgtagtgtagcatgtttgggaaaaaaatggagttggaggtcagaggtctgtttgcattgaatcctggcttaactaaaaatacattaggtgtgtccagtttacaaaatagcttagaaatgagatcttttaagaaactctatacaccatggaataatatacagccatagaaaagaatgagatcatgtcctttgcagggacatggctggagctggaggccgttatccttagcaacctagtgtaggagcagaaaaccaaatgctgcctgttctcccttatgggtgggagctgaatgatgagaacacatggacacatagaagggaacagcacacactgccgcttgtggaagggtggaggatgggaagagggagaagatcaggaagaataatggatacttattcttcctgaatcacccagggtgatgaaataatatatacaacaaacccgcatgacacatgtttacctatgtaataaacctgcacaccctgcagttgtactcctgaacttacaagttaaaaa

SEQ ID NO: 51164 - DNA, 1375 bp, Homo sapiens
tccacaagtttgaagaccagttacttctagtacgagcccttgggtgttttcatctaaagtagaacagaaagaacaggaatggcacttgtggcgatcctaaagccttgcaatgaaataattagtagattggttctgtttcaccttttactgacacttgctggttttgtggcttacttaaaaatagtttattttattataatccaaagataaatgaagaaaggtttgaattcaccaatcctacttttcccactgggatgctaggctagaaaaatagtttcttatgctaataactgtgattaaagccaaagcatttacttaaataattaactttacaaataaaaaagttcaaagagaaaaaaattcatattttatatccctgttgggtaaacaaaaccaaatgtgaacgtgggcaattgggcatctttgcctgacccagcccagtgggcacatggtggcctggccagcggtccaggacgttgccagaaccatagctaaggaggtgccacttgtacacagctgtcatggatctatatattgattacaacagctgcccaacatatgacaataaagtgtcctgaggaaagggtgtcttactcttattcactcaagaggcactctacaggccagcagggagggtccctgagtgtgtccctgagacttctctgccttttaggtgttggacccttggcagatgaggacctctggcctcactgggccccttgctatgagccagctccttcaaattctctcattaaagctcagtgaagcagcctttgcagagagcttcctaatccatgcacacttcacccttttggctaaagttctgcagaaatagtcaggggctccattttcaatcaagagtttgatagtcactggaacaccgtgccttaaatgaaacccaaggacttacctgcatgcctgccgtgctactctgcctctctggctagatctgaggcagccgcagctgtgatggaaggaggactccatgccctgcagcagtcacagcctttttgaggagacaaagcatttgaagagaatgtgcagcaataaacatctatcttatctggggtcagtgagggtttctggtcccttctgacaaagaaattggcagcagagattccataaaaatttcaataagttttagcattctgaaacacttcaattagtttgatgttaacgtttaagcaccttgatgaaataaatttatctcttccaaatcctagaaagaatctccctttcggcaaagattctgcagatgggttttgatgccatttttccattttgtagttagatctctatcatttatcacactgtagaccaaatggtcgttttagtgccattaaaaactgatttgcaatttgctgttaaattaaga

SEQ ID NO: 51165 - DNA, 407 bp, Homo sapiens
ttctgggaatcatcagctggaggtgacttgtgaagagagaatcattaggatgctgatacatagctatatgcaaagaaggatttcccaaataatttaaattcattgtatttgtgagtttagattcaactcaattggtctttctatataaaaatttttccaggctggtctcaaactcctgacctcaggtgacccgcccacttcagcctcccaaagtgctggtattacaggcttacaggattacaggattacaggtgagccaccatgcccaaccactcttatttttttttgaggcagagtcttgctctgttgctcaggctggagtgcagtggtgcaatctccacttcccgggttcaagcaattctcatgcttcagtggcctgagtagctgggattacaggcatgtgtcac

SEQ ID NO: 51166 - DNA, 221 bp, Homo sapiens
gaaaaactcaggatttgagttatagaagatctgggttcaaccagaggcttaatgtataacattaacttttctaatccttgttccccccatataaaaaaaaaaggcgtcataatattgcaggcccaccctaaaaactgtaacatacatgaggtgattagcatagtttctgggaaaattgtatacactcaatattttgtagctattattacttccgagcctag

SEQ ID NO: 51167 - DNA, 1154 bp, Homo sapiens
ttctaggtccacctatgtctgaagctaaattcagtatctaactgctaatgaacaagtttccaaaatactgtaaaaatacaattagtcaatttgagtaaatgcaaatatgatgagaaatcaatttgctatttggcctggcaaatgggaacagtaaaattctgctttactcttctctagtctccttgccccagctgcacccactaccccaaagttggcagttttgaggtatgattttcaaggaatttttttagtattaacatctccctctgagaactatgtacctaaggtcacgcatacaactagtcaattctgtttttattactctaactatgtagaaacagtaagtcacttaaaacaatcacttggctgggttttttcccctttgtgccacattgattcaccctgacccaagaactccagggaaaattctttcatgtcaactgggcaactcattaacctctctttaacatcaagggcttgggaaaaaaaaaaaaaaaaggtcagccacaggaataacaaaaacctggaatttatctttcaggttttgctttctctttctcactttgtttaaagtatctcgtactcacagttcacaaattaaccttcactgtctctttcacattaagagcttatgcttaaagcatgccccccttttctaacttgctggtttaccataaactcccctaagtaataaaattcctaacccagtactgagagtcctccttctctgccacttgggcattattttactagtttctaagccatcatcgcacaagaatccaaaaacccttaaattttttaaccactggcaaatatgtacagcaaattaggttaagcatttaatctggctcatgctctatcatactaaatattcaggtttatcataaactccttaaaaaccatcaaaggtcaaccagaaactgataactcttgaaaggagcaaacacgtaagatctttggagtttaagcttttctgagatgtgttgtgaaaaatctaacgtgtttatcgtatattcaatgtaacaacctggagaatcacaactatatttaaagagcctctggaaaatgaggccagtacagtgtgactacatgtttaattttcaatgtaatttattccaaataaactggttcatgctgaccacttgtattcaact

SEQ ID NO: 51168 - DNA, 786 bp, Homo sapiens
tctgtaagattataataccatatttttattgtaccttttttgtgtttagatatgtttagatacacaaatacttattactgtgttatagctgcctacagtattcagtacactaacgtgatgtacggcttcgtagccggccatgccctatagcctaggtgtgtagcaggctgtgccatctaggtttgtggaagtacactgtgatgttcgcacaatgacaaaatcgcctaaggacacattactcagaacgtctcctagtcgtcaagcaacacatactgtagtcgtaaattagataagtccaagccaggagttttattattctcccaaatgagaattggcatatttatgctgcaaacataaggcacagctgacttacataccccttttgggtatacaccaccatttgggtgatgtggattgttggatgctacagtatggtgcctggcaatcagggtggaatatttgaaattgggaaccgacctagcttattggagagctattgtcaaatatagtcaaaagaaaatatgtgaaggaaggtacataacccaaactgaagagatttgtgttttctaaagtgttctgattgagaaattttaaaaactagaattagcctcagccatcagtgaagtctagaaagccttcgttggaattagattgtctaagtacgctgtggtaggactgagatctttcaaatcagatgcccctgatgcttgggctgacccatcagagctttagcttttttctgtctgcatcttacaggctccagttaaactagccatttgcaggtac

SEQ ID NO: 51169 - DNA, 214 bp, Homo sapiens
accacaagagatagtcttttctttaaaaaatctacataagacaataaggtcatgaaaaatattgagttcttagagtcatgtttaaaacaaacttcaggatgggtatagtagcccacacctgtaatcccagcactgtgggagaccaaggcgggaggattacttgaggccaggggtttgaaaccaggctaggcaacatagagacccccatctctat

SEQ ID NO: 51170 - DNA, 2065 bp, Homo sapiens
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttcgtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagcactttgggaagccaaggcaggtagattgtagcccaggagtttgagaacagcctgggcaacatggcaaaaccctgtttctacacaaagttagctgggtctggtgcctctgtggttccagctcctcagtaggctgaggtgagaggatcacttgagcccaggaggtctaggctgcagtgagcttatgttcatgactctgtattccaggctggatgatagagcaagatcttgtctca

SEQ ID NO: 51171 - DNA, 2210 bp, Homo sapiens
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccaccatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttacattcttttaattttgaagagtcacaaaactcacattatttagagcaacaatatttgtatttggaaattaaaaattcatgatttcaagaaaatacataaaatttacatttttgagtagtttgaataagtttctatcttaattataatatttgtaggaaataacaaaacaaactcaaagcctttattatttccagtctctttgtaactgatgtggtatggtatcatcatgaaatctaaacagtggtacactgagt

SEQ ID NO: 51172 - DNA, 2144 bp, Homo sapiens
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggatatccagttgtgtcagcatcacttatcaaaaaaccattattttcccactgtgctgcagtattgcctttatgatatcagggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttcgtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagcactttgggaagccaaggcaggtagattgtagcccaggagtttgagaacagcctgggcaacatggcaaaaccctgtttctacacaaagttagctgggtctggtgcctctgtggttccagctcctcagtaggctgaggtgagaggatcacttgagcccaggaggtctaggctgcagtgagcttatgttcatgactctgtattccaggctggatgatagagcaagatcttgtctca

SEQ ID NO: 51173 - DNA, 694 bp, Homo sapiens
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagaagaaacagtttgtgtgaaggctgtaaggcttggagaggttttggctattttgacgactagaaggtgggccatatgagtgtgactgaagtttagtggaagacatatggtgtggaatgacccagaaggactacatcacagcaaggtttttagtttattttaaccacacgttgacttttattctaagagccacgggaagctatttaaaagggttttaagaagaggctacgctttaggaggccgaggcgggcggatcgcctgaggtcagaagttggagaccagcctaaccaacatggtgaaaccccgtctctactaaaaatacaaaaaaattagcctggcgtggtggtgggcgcctgtaatcccaactactccggagccttaggagaatcgcttgaacctgggaggcggagattgcagtgagctgagatcgcaccattgcactccagcctgggcgacagagcaagactctgtctcgca

SEQ ID NO: 51174 - DNA, 436 bp, Homo sapiens
gacaacatagtatatactactgggaaaaatctcactagagcttatttaaaacataattgtttgatgatacgtaattcaactcagaatcagatatgaatcaaatcagaatcaggtatggtgagggataataaatggaaaagaaaaactcattgtagcagcaagaaaagcttggcaaaatcaactcctctaaaggacaaaattgtttcttgattatagagattttgttatttagcaagtattatttctcttatctgttatcttttcataattctgtttcagggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagta

SEQ ID NO: 51175 - DNA, 721 bp, Homo sapiens
ttactcagatgaggcttattgttgccattgattgatttttataataaattcattctataaatttaaataaaaatatacctgttctaattaagtgtggatttacctactacctttggaaagagcagacattgataaataacttacttgtttttatgtatttctttgataagcgtttgttacactattgttacgtaataggttttaggctctaagctaacaatataggtttgacaggctacaactgacagcctttggttaaacataaactcattgggtttccatataattgtgcatttagaagaatactttattgctttaagactttttggaaacgctgacttgtaaagtatcctatgtctttgagtcagctgactcccatcttttacttttgcaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttcgtttttaggtcaaagataaccactgcattgttaa

SEQ ID NO: 51176 - DNA, 1432 bp, Homo sapiens
  misc_feature (1388)..(1388): n is a, c, g, or t
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggcaggtggctgtgagaggaccgagctggctatggcagcaacccatgaaagtgagtgataacaacatttattgtttcctgtggcgttgctttgctttgctattgactggtagcncttgtagctttaaataaattgaggaagtatgagagagtaaatgg

SEQ ID NO: 51177 - DNA, 2208 bp, Homo sapiens
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagaagaaacagtttgtgtgaaggctgtaaggcttggagaggttttggctattttgacgactagaaggtgggccatatgagtgtgactgaagtttagtggaagacatatggtgtggaatgacccagaaggactacatcacagcaagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttcgtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagcactttgggaagccaaggcaggtagattgtagcccaggagtttgagaacagcctgggcaacatggcaaaaccctgtttctacacaaagttagctgggtctggtgcctctgtggttccagctcctcagtaggctgaggtgagaggatcacttgagcccaggaggtctaggctgcagtgagcttatgttcatgactctgtattccaggctggatgatagagcaagatcttgtctca

SEQ ID NO: 51178 - DNA, 107 bp, Homo sapiens
ccatttttacctgaacagaaatacatattttgctctctccaattattcaaggtcattacagtatgaactatcaagatcatttttttaatttaaaatactgatttggg

SEQ ID NO: 51179 - DNA, 316 bp, Homo sapiens
gataaccagagaactgctaattgcttgatttaattctagtctaaagcccagatgaaaaatattttaagatactgaaggaacagtcagacatagccccaaacatcagttggtcatccccaaagcccctagaaatctacttcctgtctctatggattttcctattctgcacattttgtagaaatggaataatagatgatgaagccttttgtgtctgacttctctcggctaggatgatgttttcaaagttcatccatgttgtagcatgtttcagtacgtcattcctttttatggaatgatatgtgaaataatattccat

SEQ ID NO: 51180 - DNA, 122 bp, Homo sapiens
gataagatagaatagaatttctttttttacctttagtctcctagaatatgctgcttataatgaaaataatacttgatattttagaacctctccctacttaccttatttgaattaagtgcctt

SEQ ID NO: 51181 - DNA, 263 bp, Homo sapiens
gccttgggaggatagatgaaagaagaatgacagatggaggtcactgaccccagcatctcagctggagacagtctttgggttagctttggtggggatgccctgagaccactggggacagcccttatcaacacattttcactgaagccattttgcctcagcgagttatccagtggccagagctgaagtcacaagggaagcgtgtgtgtgtgtgtgtgcacgtgaacgtgcacacgcatatgtgtggtatggggtcatttcatgcc

SEQ ID NO: 51182 - DNA, 209 bp, Homo sapiens
gcctcttctagatggcactaactaaggggaatttagaatggggtggaaggaggaaaaggaaaggttattaccagacccattctctccttttgctttgaaattcatggtactcgataattggttcacatccaaagagttaactgaactagatgaggtgctgtgtaacttctgcaggccagagggaagagaagagagtaagagctaacaag

SEQ ID NO: 51183 - DNA, 460 bp, Homo sapiens
cactggaatttacttgaagtttgtggaaaggttgtggattggtggcaaatcaccttctctagaaattggtactgataaagcacaatgttgtgctccctagaagctgagaggtggtcctgactgaagccaggtggaggaggagccattgcttagatgaacctctaaggtcccttctgggcttatgatgctaggttattagagccagtgtagtgagaggggtatttgtctttcttctaccattcctttcctgggcactttgtatgtccacagacacccaaaagggctccattttcccaggtcttcctgcccattgacccaccctttcctccttgtctatatctgacaacctctcattgccttctcgttacttgattccttcttggatccaggatcctaattgtagagagaaagaagaacagtgagagggcttagaaaatagaatcccaacctttattcatca

SEQ ID NO: 51184 - DNA, 1630 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51185 - DNA, 1814 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaaaaaaaaacaccacaaaaagggggggggccaaaatcccgggggccaattcgcgcccccgttttgtaaagggcccaagggggggaaaagagggggcgcgtaaaggcgggaagcgtgggttctggggaccctgggggttgcaaccccgaagcgggaaatgggggccctggggtgtttgttcacacaa

SEQ ID NO: 51186 - DNA, 470 bp, Homo sapiens
agcggccgctactactactactactaccacccccgcggccgctccaccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51187 - DNA, 1111 bp, Homo sapiens
ttcccatctctctctcgttcttctcttctttctttctcttttggtctttcttgtctctccttgtcttttcattcttcttttgtttttgtttgtttcctctttctctctttttttttctgcttgttttttttttcatctctctttcttttcgttgtttttcttttcttcgtttgtcctgcgattgctttcttgtttgctgttttctttctctctctcgttgtttctttctccgtcttttcttttctctgtctgtttgttcttttgcgtcttcttctcttcttttttcgtttgtcttctttcttctgtctttctgtttctctcttcttcgcttccgcgcttctgtttgcctgcgtcctgctcgtccttgctctcctcctcctcttcttgtttaatcagtgtagtgcggctgtggtggtaatttttgttcctcttatctgtcttgtgtgagtgttttctccctgctggtagtgttgtctgtgggtgtttgctccattcatagtctcgtctatgttgtttcgtcctctcggtggtgttatctcgttctcgtgtgtgtttgtcttccctgctgttgtgttgcgctgctgcctcagttttgttggttgcttttcatagatcgtctctggttgcgctgtttgttttctcttccctatcgctggttttttttttcgcgtcgctcgtctttcagttatattagtatctacgcctcttctagtgtggcgcgctctttttttaaatacgtctgggtcggtgtgttctgtgtgtctcgccccgctggggagatagttattgcatggcgcgcgcgcccgccctcttttttttttttttttttttttttttttttttttttttttttttttttttttttttttttttttttttttttttttttttttttcttttttttttttttttttttttcgtttttttttttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51188 - DNA, 237 bp, Homo sapiens
gcggccgcctactactactactactgctcgaattcaagcttctaacgatgtacgggtgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51189 - DNA, 262 bp, Homo sapiens
  misc_feature (25)..(25): n is a, c, g, or t
  misc_feature (29)..(30): n is a, c, g, or t
attaaagcaaacctttaaaaaaaanaaannacctgtggttactcaaccattgtcacaggaaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaa

SEQ ID NO: 51190 - DNA, 130 bp, Homo sapiens
tgcccaataaacaaaacatcagcagaacatatcttcattaagagtttttggaaaactcatcaaattcgatgaatacattttcttcataacccatttggaattattcctaataaaatgataaaatacgtaa

SEQ ID NO: 51191 - DNA, 171 bp, Homo sapiens
gcggccgcctactactactactactgctcgaattcaagcttctaacgatgtacggggacatgtttgataaaattggtctaggcttgttacaacaaaattagtttgtatcttggttattaaacagtatctgggactggtttgggcagaatattaaacttattttgttgccaa

SEQ ID NO: 51192 - DNA, 1655 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattgcggtcatttttgtttttctttgtaggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51193 - DNA, 1412 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcgcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51194 - DNA, 1520 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattgggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51195 - DNA, 1163 bp, Homo sapiens
gtgttccttgtgtcgaaatatgtcatacgggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51196 - DNA, 1131 bp, Homo sapiens
aggtataagttttagtgccatgcgcagacactccattatcttataggagggtgtgagggaagatacaactaactggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51197 - DNA, 957 bp, Homo sapiens
cgtgtcacttatagctgtctctagaggatccaccgacagcacacaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51198 - DNA, 1403 bp, Homo sapiens
tgtagagacagggtttcactctgttgcctggactggcctcaagtgatcctcgtatcatggcctcccaaagtgttggtgtttcaggcacaagccatagcacccggtcctgaaacctaccctttacaagaggtaatgcccctaaaaagggacctaattttattttgactgctaacttcccatttttattcttttttttttttttttaaatgtaaagacaaagtctcaccatgttacccaggctggtctcgaactactaagctcaagtgatcctcccatctccgcctcccaaagtgctgggatttataggtgtgagccaccacgcccagccagaagtagctttaaatatgggagagttttgtgagatgcaagaggtgtgaaaagactcttaagtttgattaagaaagtttaaacactggtgttatatattaactttgttaatcaagtattttcttgtcttctctttacagtggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51199 - DNA, 943 bp, Homo sapiens
ccgtttctagaggaccccccggaagcacacaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51200 - DNA, 1734 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaagtaggagaatatggcttaaagacaagacgggggagagcctcgttaattgttcatactattttacttcaccctccatccagtctgacacaatgccaaacttaatc

SEQ ID NO: 51201 - DNA, 1623 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaaccttctacctatgcaggtgccatcagtctaaaaaaaaggaatgtatatgc

SEQ ID NO: 51202 - DNA, 1527 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgatacgtcctgcgggatcctctgaa

SEQ ID NO: 51203 - DNA, 1474 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgtcatatctgccccggattacacgccg

SEQ ID NO: 51204 - DNA, 1490 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgtatcagtggccgcggtttatcctcaggagcagctatgaccat

SEQ ID NO: 51205 - DNA, 511 bp, Homo sapiens
gagaggatcccctcctagagcgcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51206 - DNA, 1191 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatctttcaccatttattcccttcacacaatatcctattcaccctatcccctactctctaactcttctcaatctatctctctcttcacttctca

SEQ ID NO: 51207 - DNA, 919 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaa

SEQ ID NO: 51208 - DNA, 1409 bp, Homo sapiens
  misc_feature (20)..(20): n is a, c, g, or t
  misc_feature (23)..(23): n is a, c, g, or t
aggatcccctatatgcaagnggnctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51209 - DNA, 1489 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 51210 - DNA, 2018 bp, Homo sapiens
  misc_feature (1653)..(1654): n is a, c, g, or t
  misc_feature (1659)..(1659): n is a, c, g, or t
  misc_feature (1663)..(1663): n is a, c, g, or t
  misc_feature (1665)..(1665): n is a, c, g, or t
  misc_feature (1675)..(1675): n is a, c, g, or t
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaacaaaaacacaacaacaacaaaannaacanacananaaacaacacnacaacacgaaacaacagaggagagggggcgcgcgcgcgcctctacgagagatattctcctctcgggggggggcgccccccagatcttgagcggcgtcccacaccaggttttcctcgtcgcgaacacaacgggcggggcgcccctagacaaagagagagcgccgagaaataataaaagcggcggagccgcgcggcgccacgagagtacaaacacaacagcgcgcacacggggagcaaaccctgccaacacctgggaaggccctctcgggacgaagagcggaacccctataacagtacgggagagggggcggaccaaaatcttggcggcaacacaacttagccag

SEQ ID NO: 51211 - DNA, 1646 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaacgactcgtgggaagcctgttctgcatcctgctgcgcttgtggaagcgtttttcctgcttaactcttgcatgct

SEQ ID NO: 51212 - DNA, 1494 bp, Homo sapiens
  misc_feature (1489)..(1489): n is a, c, g, or t
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgtcagtgtgctgtcggtggatcctcaagagtcagctatgaanatgtc

SEQ ID NO: 51213 - DNA, 1485 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagccgccttcctcctatatgagccttttcttcactggttcctgtttcctccgcctccgtatcctctgaccg

SEQ ID NO: 51214 - DNA, 940 bp, Homo sapiens
agagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaaaaaaaaaaaaggggagaaggg

SEQ ID NO: 51215 - DNA, 107 bp, Homo sapiens
tctgtgggccaggtgcagtggctcacacctgtgatcccagcactttgagagggtcaagacaggcagtttgatagcagcctgggcaagatggcgaaaccttgtctcca

SEQ ID NO: 51216 - DNA, 1094 bp, Homo sapiens
ctgcccacaggaaaggttgtaacacactgcagggcccagccaccaggtgatatgtctctcctgcatgtgcataactttcaggagaaaattgtaacatgccactggttgaaaacccagatgatgtgactctcctgccttttcacagccctcagggaaaaaaattacatatcatttgcccagcatccaggtaatgtcactctcctgggtggtttgtgccaacaagttggttggtaacatatatctcggcccagctcacaggtttgatggtgactctaatacctcctaccagccaatagaagagacactgtctctcacaggtaggcttagaaagaggagtaaaattcctggctgggtgtggcggctcacgcctataatcccagcacttcaagaggtagaggtggacggatcacctgatgtcgggagttcaagaccagcctgaccaacatggaaaaaccctgtctctactaaaaatacaaaaaattagccaggtatagtggcacgtgcctgtaatcccagctactcgggaggctgaggcaggagaatcgcttgaacccaggaggtggaggttgtggtgagctgagatcacaccgttgcactccagtctgggcaacaagagtgaaactctgtctcacaaaaaaaaaaaaaaagaaaaagaaaaaggagtaaaatcctggtggtctctctgtatgaaggttatagagaattaccactctcttgtatattgtgtaaagcacttggatggtacagagcatgtcttctgtaccataggacccagcaaacaggttagatcatgtttcatgtaagcacatcctgccagtttttaggattgtcatcctcacacatgaaagagcccactgactgatgaggtcataattctcatggatggatgcagtccatacttaaaattgtgactatcttatgtgaacatgtggccacacttgagatggtgaatcatttctaaacccagctcatagtggtgaggactctcctctctggacccagctaattggagagatgttaaatgtcatacctagacttgggaccacattagatcatgtgttcagagcaggttgcaactctcaggcacaccatat

SEQ ID NO: 51217 - DNA, 1238 bp, Homo sapiens
caatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggaggttccagaggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggc

SEQ ID NO: 51218 - DNA, 639 bp, Homo sapiens
taatagttatgactgtaatatttatgctgtaatagttaatgctgtaatagtttatacagcataaactattctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactattgtctttggatatactacagcataaactattgaggagtatcctgaggcatgggggtcaggggtatactacagcataaactattggttacatataaaattttgttacatgtatataatgcgtagtgatcaagtcagagtgtatagggtgtaccacacccaagtacaatatatgttagataagataatcaacctaatctgcgat

SEQ ID NO: 51219 - DNA, 338 bp, Homo sapiens
agaatgtgttcgggtagttcctgcaacctcccgcggtggagccccgcctccagttcccatcggcttggcatctatgaggttccagaggaggttccagaggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggc

SEQ ID NO: 51220 - DNA, 144 bp, Homo sapiens
cctctcagaagcctccaagcctgagaccagggccaccccccacccccatgcattcctgctcagggctgggctcctctgcccctttctggctgcagacacattctgagagggatggagataaagggagatggtggcaggtggtgg

SEQ ID NO: 51221 - DNA, 3334 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51222 - DNA, 3341 bp, Homo sapiens
gctcccgtgttatttctacagggcatgcgttgatttactgtgatctccggcctcggtatgtcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51223 - DNA, 3870 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaagtaagatcccagagatgcgggtggatctgtgttgggaaacattctgttcatatgctttaagatgcagcaactcctgcacagagtggagaaacatttccaaggggattgggattttacccataatgaagctcagagtgagtaaagatggggctgaggaaatgcaaacaaaaaaccaaccaggacttcgcaggtgaaatggcctattcccttcctcctgattattgggatcatctaaaggccaccatcaagggtttcctgaaaagggtttttgacagctaaagtacaaaaattatataagacaagaacatggacctatgggcgttggctggctgatttgatgggcatatttacaaaccagtcacagacagaagcaaaatactattagttatttaaggcagaaacataagtgattcttccacggccaaactagaggcacagagctggaaaaacttcatccccactcagcacatactagggaggtaacttgccagctttgctttgggtcatagttcttacagctaacttatgtgttccagaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51224 - DNA, 3512 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaattca

SEQ ID NO: 51225 - DNA, 3039 bp, Homo sapiens
caaaggaacgaatttccaggatgttcgactatgtggagaaaacaaaaaaaaaagcaaagaaaaaaatatttttaaagaaagaaagaaggccaggtcagtgcctcacacctgtaatcccagcactatgggaggccaaggtgggaggatcgcttgagccaggagttcaagaccagcctgggcaacacagagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51226 - DNA, 2787 bp, Homo sapiens
gcgcttccactcgatgccccgggttttgctggagtagggccccaactccttgaagcccagggccgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51227 - DNA, 3456 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagaggtatttgtaactctttgaatttcacccactctgtcctggacaatccagagagcagaggagcaaaaaaactccaagagtttttggacttcacgaacaaagcctgaaactaaggataaagccggttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51228 - DNA, 2588 bp, Homo sapiens
gctctatcttgcttttcctgtgtaacttgtatccagctatggtagaaggatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51229 - DNA, 2763 bp, Homo sapiens
caatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51230 - DNA, 2238 bp, Homo sapiens
  misc_feature (27)..(27): n is a, c, g, or t
cgagctcggtacccccattccattccngcgtgggggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51231 - DNA, 3842 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttggcctcccaaagtgctgggattaagaggcatgagccaccatgcctggcctcttttatctttttcttttcttttcttttctttttggggggcacagagtctcactctgttgcccaggatgaagtgcagtggcatgatctcgactcactgcaacctctacctcctgggttcaagtgattctcctgcttcagcctccccagtagctgggactacaggcacgcaccaggatgccaggccaatttttgtatttttagtagagacggggtttcaccatggtggccaggctggtcttgaactcctgacctcaggtgatccacccccttcagcctcccaaagtgctaggattacaggtgtagccaccgtgcctggctgcatttcagtttatttttcagtaaaactggtcaaccatccacctcactgcactaccgtggaatgacttaaattttgcgagagcatttgggcccacagtcaccgcttgctgaagcagatgggatgcctggtccaaggtcacgattattaaagtagacacacggggcactttgacccacctgtagtacatttctttcacagcaaggcagtgcaaccggtagcacatcgggctcttttagatgctgctccagccttggtccggtggatcatgcttggtttagaagctgggttgtctttctcctgcccccagtcctgtctttgcttttatagtgcatcatacaccacgtagaaccgagccaggttcctgccatgtggacgctgttcctgcctgagagtctcttagaggaaggctgggaacactgtggaaagactgggcatctctgcaggcggagctgaatggatgtgaaacccctgtgggcatgtgcttccgagttcctcagcaggcatttgtgttttttggtagaaagtttgctttttgttttttttttttttaagacaaggtctcattctgtcacccaggctagagtacagtggtgtgatcatagctcactgccgtccttgaactctcagactcacgtgagcctcctacctcagcctcctgagtagctgagactacaggcgcttgccgccacccctggctaatatttttattttttgcagagacaggggtctcactacattgcccaggctggtctcaaactcctggcctcgagcaatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcattaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51232 - DNA, 3454 bp, Homo sapiens
caaaccctctgacccaaccctcatatgggggactgcctgaaacttcactctgtctattcacaggttgtcttaggctttaagcccctggaggtggagacaagatttttaacatcctcctggttctaagaccctctgataagagctccttgtgctgtgttcacaggtgactgctggctgctggcagccattgcctccctcaccttggcctcccaaagtgctgggattaagaggcatgagccaccatgcctggcctcttttatctttttcttttcttttcttttctttttggggggcacagagtctcactctgttgcccaggatgaagtgcagtggcatgatctcgactcactgcaacctctacctcctgggttcaagtgattctcctgcttcagcctccccagtagctgggactacaggcacgcaccaggatgccaggccaatttttgtatttttagtagagacggggtttcaccatggtggccaggctggtcttgaactcctgacctcaggtgatccacccccttcagcctcccaaagtgctaggattacaggtgtagccaccgtgcctggctgcatttcagtttatttttcagtaaaactggtcaaccatccacctcactgcactaccgtggaatgacttaaattttgcgagagcatttgggcccacagtcaccgcttgctgaagcagatgggatgcctggtccaaggtcacgattattaaagtagacacacggggcactttgacccacctgtagtacatttctttcacagcaaggcagtgcaaccggtagcacatcgggctcttttagatgctgctccagccttggtccggtggatcatgcttggtttagaagctgggttgtctttctcctgcccccagtcctgtctttgcttttatagtgcatcatacaccacgtagaaccgagccaggttcctgccatgtggacgctgttcctgcctgagagtctcttagaggaaggctgggaacactgtggaaagactgggcatctctgcaggcggagctgaatggatgtgaaacccctgtgggcatgtgcttccgagttcctcagcaggcatttgtgttttttggtagaaagtttgctttttgttttttttttttttaagacaaggtctcattctgtcacccaggctagagtacagtggtgtgatcatagctcactgccgtccttgaactctcagactcacgtgagcctcctacctcagcctcctgagtagctgagactacaggcgcttgccgccacccctggctaatatttttattttttgcagagacaggggtctcactacattgcccaggctggtctcaaactcctggcctcgagcaatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcattaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51233 - DNA, 1845 bp, Homo sapiens
tgctgaggtgatctagaggaccccaacgatggtcctcagctatcggctggcatctatgaggttccagaagagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51234 - DNA, 1920 bp, Homo sapiens
gtaccgccattatccctggcccgtgggggtggtccatgacatggtgtccactacctgctgctgtgggctgactctgcatgtgtcaggtggaagagggcacggaggtcatcacaccatcggcttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51235 - DNA, 1860 bp, Homo sapiens
gcttaaattctcctcctcctctgctgcactctatatttatctgttgaaattttcatgcactgaaaccatttctctatttattcctcattaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51236 - DNA, 3592 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaaaaaaaaaaaaaaaaaaaaaattggtgggggcgcgcccgggccccgagagaaagttttcaaaacccattccgttggggcgccggcggcccaggaggttatctgagaccctgggccaaaggcggggcccaaaggaaaccccggccatgacaggggcggggttccccaccaactaaaaaaaccgccggggcaccgcggtctgacaaccaggggggtccggggccatacgggcttacaacagggccaaggagcgagaatag

SEQ ID NO: 51237 - DNA, 3484 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaaaaaaaacacggaaacaacaacgacccaacacaacaaccaaagaaaagacacaacacaacgaaacaacacagcaatcaccctggaccacacgccaccccagcgacaacaacagagagaagaaggaccgacccgccgacgccaggagagag

SEQ ID NO: 51238 - DNA, 3312 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatctgcgggacctctagatcacctgcgagcacac

SEQ ID NO: 51239 - DNA, 1766 bp, Homo sapiens
ggtcatagctgactccagaggaaaaaacaacgcctagtgacacagaggagttgacacttggcaaggttcttggggtaaaacccataatgaagctcagagtgagtaaagatggggctgaggaaatgcaaacaaaaaaccaaccaggacttcgcaggtgaaatggcctattcccttcctcctgattattgggatcatctaaaggccaccatcaagggtttcctgaaaagggtttttgacagctaaagtacaaaaattatataagacaagaacatggacctatgggcgttggctggctgatttgatgggcatatttacaaaccagtcacagacagaagcaaaatactattagttatttaaggcagaaacataagtgattcttccacggccaaactagaggcacagagctggaaaaacttcatccccactcagcacatactagggaggtaacttgccagctttgctttgggtcatagttcttacagctaacttatgtgttccagaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51240 - DNA, 3280 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51241 - DNA, 1537 bp, Homo sapiens
cccttaacctccacaggtaattcaacaaaactgctctccagaacactacgagccacagcttcaacttcaaaggacctgcggtgcttcatatccctctagaggagcctgttctgtaatcgataacccccgatcaacctcaccacctcttgctcagcctatatacccccatcttcagcaaaccctgatgaaggctaccaagtaagcgcaagtacccacgtaaagacgttaggtcaaggtgtagcccatgaggtggcaagaaatgggctacattttctaccccagaaaactgcgatagcccttatgaaacttaagcggatcagcgctgatccgttaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51242 - DNA, 1166 bp, Homo sapiens
ttgacaagattacttcatgatataccatgtttcccagttggctcatgggaaatggtaatcttggactgttgtttggttcggtggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51243 - DNA, 1077 bp, Homo sapiens
ctttgaagttataactaatctgcctgaagacttcaaagtactgagaaacagagccaagagataaggtggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51244 - DNA, 3877 bp, Homo sapiens
  misc_feature (3318)..(3318): n is a, c, g, or t
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaagtaagatcccagagatgcgggtggatctgtgttgggaaacattctgttcatatgctttaagatgcagcaactcctgcacagagtggagaaacatttccaaggggattgggattttacccataatgaagctcagagtgagtaaagatggggctgaggaaatgcaaacaaaaaaccaaccaggacttcgcaggtgaaatggcctattcccttcctcctgattattgggatcatctaaaggccaccatcaagggtttcctgaaaagggtttttgacagctaaagtacaaaaattatataagacaagaacatggacctatgggcgttggctggctgatttgatgggcatatttacaaaccagtcacagacagaagcaaaatactattagttatttaaggcagaaacataagtgattcttccacggccaaactagaggcacagagctggaaaaacttcatccccactcagcacatactagggaggtaacttgccagctttgctttgggtcatagttcttacagctaacttatgtgttccagaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctctgtgagtcagcaggccccgccttgcttctaaggggatgggggaggcatggggcggaaagggctgttacttgagtgatctgctttttcaagttttgctttaaagagctcttggtctgtcggggccaggcctgtaaccggttgtaagatcccacaatgcacttttacttgcagttgttttccaaccacctattctcaagtccaaaatgcacgcctggctccctcttctcatgagctttgacttgagtgtagctcaaggttaaactaaggagtggctgcaggatcatgcttagaaaaatgaactcctgattagcatgcaagggagaacatgtttatataaagaaatccttcagctgaaattcaagttgggttttgggaagatccatcattcttagagtggatctacttaaaatactttaagcaaattagttttctctactccctccccgtttaagataaaacnaatactagtaaatacgtttgccatttattattgttattgcactcatgtgtctggaaccctagcaatacacatctctgaaatgatcatcaatctgaattaagtgggtatgctaatttcacaaaaagcaaagcgtaaaatgttctcgtgtcatcccaatgacaggaagttctctcactgaaagaaagaagccaggtggggtatacttccattatcacctggctccagtcagcatttcctctatactcagggaaggccacagagggccgggcgaagtggctgacactgggtgagaatggcagttgtcagtcctgtccgtgtaacagaggagtgaagtggtgaggagggcaggtctaaggcactggcagctcttttccatggattttgaactctggaggaaggcagcaactaaataactgtctcattctgctattatgcattgtattagcaaagtgaaaatatagtctatctggttacaaataacactaacttgcttaaaactttacatatcctaggaaatatctctacccctagattgcaatgtagagtcaaccccatctct

SEQ ID NO: 51245 - DNA, 3171 bp, Homo sapiens
  misc_feature (2612)..(2612): n is a, c, g, or t
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctctttgttttccaaccacctattctcaagtccaaaatgcacgcctggctccctcttctcatgagctttgacttgagtgtagctcaaggttaaactaaggagtggctgcaggatcatgcttagaaaaatgaactcctgattagcatgcaagggagaacatgtttatataaagaaatccttcagctgaaattcaagttgggttttgggaagatccatcattcttagagtggatctacttaaaatactttaagcaaattagttttctctactccctccccgtttaagataaaacnaatactagtaaatacgtttgccatttattattgttattgcactcatgtgtctggaaccctagcaatacacatctctgaaatgatcatcaatctgaattaagtgggtatgctaatttcacaaaaagcaaagcgtaaaatgttctcgtgtcatcccaatgacaggaagttctctcactgaaagaaagaagccaggtggggtatacttccattatcacctggctccagtcagcatttcctctatactcagggaaggccacagagggccgggcgaagtggctgacactgggtgagaatggcagttgtcagtcctgtccgtgtaacagaggagtgaagtggtgaggagggcaggtctaaggcactggcagctcttttccatggattttgaactctggaggaaggcagcaactaaataactgtctcattctgctattatgcattgtattagcaaagtgaaaatatagtctatctggttacaaataacactaacttgcttaaaactttacatatcctaggaaatatctctacccctagattgcaatgtagagtcaaccccatctct

SEQ ID NO: 51246 - DNA, 2027 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggcccggctagtcgccaagcctggct

SEQ ID NO: 51247 - DNA, 1809 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggaggttccagaggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggc

SEQ ID NO: 51248 - DNA, 1592 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagcttgaagcgttgaacaacagcacgaagaaagaaaaggtgactgaggcgcacccggcgcgattcgtcaggaagaagatatgcaaaggtgatg

SEQ ID NO: 51249 - DNA, 1506 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51250 - DNA, 1413 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcactatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggtaacggccggcgcggatgtgcaggggtcctgctgtcctgacacgatggccacaggcacagtttgtggtgatgcccaggggcccgcgcggccccacggtggtccagtttacactcgggccccgcactcctgaagttccgcgcgggaggagaagggcgtccctttcgcagctcgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttga

SEQ ID NO: 51251 - DNA, 242 bp, Homo sapiens
tctagagcatcccccatgactccatgtgcacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcaca

SEQ ID NO: 51252 - DNA, 605 bp, Homo sapiens
gcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctaggtgactgctggcttgctggcagacatttgccccccttattcggttaatcaatgg

SEQ ID NO: 51253 - DNA, 232 bp, Homo sapiens
tcgtacactaacgcctctctctttactttgttttccagctgcccaagctggaacactatagacccagaggagagggaaaggctgaccagacggcatgaagatggagaattctggtaagattagtggaggcttcagggaaagctctgtctgccccaatgttctttactagaaaactgctaattagaaagagtgtcggccaaagtgagtttaccatgtcgaggacacaagcgtg

SEQ ID NO: 51254 - DNA, 445 bp, Homo sapiens
cctgtagaggggcgtagagctaggaattagcatttgagacgtttaaaatctggaaaaaattaaagcgtctacacaggcaaccctaagcagtgtggggaggattactctaaggcaactctagggaaaggcttctttatcattttgggtgttgtggacctctacaagaatctgatgacagctgttggcaaatgtgtgtgagggcatgaatgtgggtgtgagagtatctgtctgcaattccatttggcatgcaatttcaagaggttcacagaccccatgaagcacacccaagaatccaggctaagaagcccagcaaatagagatggtaaaatatgagatatcatgtcacttatgaatctttctgttatggataacaggaaaaccccattttaagccacattttaaaattattagattcaatgggcataaaatgactctgttgaatttc

SEQ ID NO: 51255 - DNA, 478 bp, Homo sapiens
ggaaaagggtggttgtgcctccagatctcatggagagacaagcaaaggggagtgggtggcatgttttgcagaagggtgaatctcaaactacacagggaatgaaagaatgctggacactggagagaggggtggaagagtggctctacatttactgagttctgtgacctaagacaagtcacaggttttttgtttgtttgtttatttttgagatggagtctcatcctttcacccaagctggagtgcagtggcatgatctcggctcactgcaacctctgtctcctggattcaagtgattctcctgcctcagcctccccagtagctgggactacaggtgcgtgccaccacgctagctaatttttgtatttttttttttagtagagatggggtttcaccatgttggccgggctggtttctaactcccgacctcaggtgatcacctgcctcggcctcccaaagtgctgggattacaggcgtgagc

SEQ ID NO: 51256 - DNA, 297 bp, Homo sapiens
cagagctgttggctgcgtggagtttgaccccttccttagtagcagcgctttgagtagtgggcagagtctcagggtgttctgtgtggttggagcaggctggtgtgccgggcctctcccttggtacaggttggtacagggagcatagcccagtctggagtgaggctaccaggggactaagaccttgctttgtcacatgagatctgtaggtgagtccaaagacacaagtgtgctgcgtggcagtgtcgctggcgttgctgtggcctcggatggaggctcttgggttcccaaaagagtgcc

SEQ ID NO: 51257 - DNA, 566 bp, Homo sapiens
gaagtactgcacctttataactttaaataagtgtttatattttaggcagcaagtctggctctaaaaatttgaaaatggggtacatttgaatcttacaaattcttaagccaaaaagggcaggcaagttaagtattttgaagacattaattaaaagttattagaatcacataaaatcctaagttagtgatttaaaaaattttaatgaatgtgaagtttgtaaaggttttgttaagttttagactatgcctgttattttcattacgtgggatagatggtcttgctagtgacttctcatttgcttagtgtaatttgtctgtacattttaaagttcatttttattgttatattttgcctcatcattgctttccttagcctgcattttctgatcatcttctgaatctgcatcttttctctgctactttcctccacagcaccttacccacagggacctaggatttacctgtgtcccagctccccctctctctcttgtggttcccttcatcttaaaaagtcctgtctcctcctctcggaatctagccttacccctcatcattctagccttgtca

SEQ ID NO: 51258 - DNA, 331 bp, Homo sapiens
acttcttagtttatcaaccatttttttaacttttactttaaaattaacaattttattataaatatgctgtaaactgcatcaggacttttaaagtattttctagtttatgagaagaaagagttaaaaatggaatggaagtgtcctctttagagaacatatttactatctaaaattctgtgatgtccatctatgatggacaacaatgacaaatttgaatgaaaacaaacaaatagacattgaattgtgaaacaaacggaacacttaatttatatgttaggaattttcgggaaagcatggagattggaatgcaaggatatggactgaagagtag

SEQ ID NO: 51259 - DNA, 302 bp, Homo sapiens
gacaagcaacaagcactcaagcacttaagaaaataaaacagctactgcctgacacttctttggcctcaggaagcccatcatgttccttggaggaaatagttaccaagcattcaccgaaccggatgccccagctgctgggagcactggcccaggtcacggttcactatgaaaaccaccatgagaaaacattgctctaggtttcaggagagcccacaccaaggactaagggggccctggaaagcagagcttatcagaaaaaggagaaaggactggactcagaacccacaaatgtgactccatca

SEQ ID NO: 51260 - DNA, 1533 bp, Homo sapiens
aggagaacagcaagaggtccccagcaaacatccacagatggccttggaacctcaccctgcaggaatgccagtgaacatactgctgacatcttggagctcagtaccctcatagtgtaacggcgtcagtagatctgcctgtgcttggacttcctgtactacccattcctgaggggcgatgcttctgcagggcctgtgacttggtgcacaacttcagacaccatcatcttgcagcagcaccgcaccctcactagccagggtgttgatgacttcctcaaggccaaggccacattcaaggcttcggactttattgatgcgcttgtgctgagcaaggtggcttctccaggatcttaattcaggaggtagaatggagcttgagatcaagtgtctgatcaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacctgtcattctgctgtttttaccaaaaaggatcatgaggatcagagaggaaaagtcacttgcccaaagtcacacagctgaacagtggtggagttcaactttgaccatgggctgtctggccccaaggtgtatgcttgcttctctcccaagagactcctttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggcgcaggggtgagaggcagggaaatggagaccccaacagccagcatcagtggccctcatcacagccctccaggagatatcaaaggagacaacgccattattgacgagatcactcccaagcggattggagattgtcccaatacttagacctatagcaaggccttgggagaaatggtggtgcagcaggagagcaggaacctaaccattgccatcctaaggccctccattgtgcggagcaacgtcgcaccagcttttcctgggttgggttgataatctaaatggatgtagctgactcattattgcggtatgtatagggatgaggaagtaactgtaatgtagtggaggaatagtaagaaaattcttagtgctggcttagcttcattgatccaaaaacataaatgctactttactatcaattgaagcatattatttcaattattctggttataatatggaggcaggatgaaattgtttttattcttttagaattttttttatcaggaaaacagaggtaaagtgctatcaattactatttaagagttctattttgaaaagtgagaattaaggatttttcttttctttttaaaaaaaacttttttaaaaattaaaaa

SEQ ID NO: 51261 - DNA, 1604 bp, Homo sapiens
  misc_feature (90)..(90): n is a, c, g, or t
gcaagccagaaaaataacagctatcagctttctaaataattttaaagtcctgagaagcatttgctatttctttttctatccccactgtantcccctccagtcgggatctgcacacatctttgcagtacctcttatagccatgacccaaacgttctataggagcatgcaagtaagtcaagcctcctattctgttagacttgagagagatggttttcattgcatagtgacattttcttagccttaacgttctgatagtagcttactactcacttctctttttcagttttcataataagtattcatttttttgccataatgcttcctataaagccaatggtcctgcggaccgcaggaccattggcaccgaattcgaatcaccctaacaagcaaaaatgtaaaattggatgcacagaaaagtgactcaaagtgcttaatgactagaagaaatctaggagcagcaagaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacctgtcattctgctgtttttaccaaaaaggatcatgaggatcagagaggaaaagtcacttgcccaaagtcacacagctgaacagtggtggagttcaactttgaccatgggctgtctggccccaaggtgtatgcttgcttctctcccaagagactcctttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggcgcaggggtgagaggcagggaaatggagaccccaacagccagcatcagtggccctcatcacagccctccaggagatatcaaaggagacaacgccattattgacgagatcactcccaagcggattggagattgtcccaatacttagacctatagcaaggccttgggagaaatggtggtgcagcaggagagcaggaacctaaccattgccatcctaaggccctccattgtgcggagcaacgtcgcaccagcttttcctgggttgggttgataatctaaatggatgtagctgactcattattgcggtatgtatagggatgaggaagtaactgtaatgtagtggaggaatagtaagaaaattcttagtgctggcttagcttcattgatccaaaaacataaatgctactttactatcaattgaagcatattatttcaattattctggttataatatggaggcaggatgaaattgtttttattcttttagaattttttttatcaggaaaacagaggtaaagtgctatcaattactatttaagagttctattttgaaaagtgagaattaaggatttttcttttctttttaaaaaaaacttttttaaaaattaaaaa

SEQ ID NO: 51262 - DNA, 130 bp, Homo sapiens
atacttttacatgtaaaagacatgccaaatactaaacatgtaaaattgctaaacatgtaaagttgcttcacatctttacttttcgaggaattgtatattaaaaatacagtaagaaccccccccaccacca

SEQ ID NO: 51263 - DNA, 759 bp, Homo sapiens
acggcatggctggtacatcaacagcatagaggcactgtcatgatttccaggcacagcttgcgtatatcccaaacatctcacacttgataatgtacctgttccttagaaacataactgggtaaggaaggattatcttagttcagtgaagccattacatctacggtctcttcagcttttataccttgttcccattctcaagtgcagcaacatctcatcagtactggaaaagcagtctgcacagtgaaccagaagtccttggtcaagtacaagtaacttcagccagattttcatgtatcttgggtttagtatattcctgtaaattatcagttacaaatttcaaggatgattcaggcacagcagcacatgtgcctgtagtcctagctactcaggagactgagagaaagaggattactagagcccaggagtttgaggccagcctgtgcaacatagcaagaccccatcttcataaataaacaaggttaggcatggtggcccacgcctgtaatcccaacacttacggaggttgagacaggaagatcccttgagcccaggagttcgagactagcctaggcaacatggggagaacttgtctctacaaaaataaaaattaaaaaaattagcagggcatggtggcatacacctgtgtttccagttactcaggaggccgagacagaagtatcacttgagcccggaaggtcaagactgcagtgagctatggtctgcactctagcctgggcaacagagcaagaccctgtctcc

SEQ ID NO: 51264 - DNA, 341 bp, Homo sapiens
ttgctctgaaacttatttgtcttttttccacgtaaggccatgtcttggggattttccaatgttggtgaatgtagagccattttctttttaatgtgatggcacagcatcccgttatgtgggtgtttcctagttgatttaacggcttttccataaatgctataggaaacaatgcagtaacttcattcctatacagacttctttgcatttaggtgtttttgcatttaggtgtttttccctaaactgacataaagaagtagaattgctggatcagagaatgtgcagagttaaaattttgataaatgcattgaaaacctttcaagaaaaattataccaattgacat

SEQ ID NO: 51265 - DNA, 746 bp, Homo sapiens
attggttgcttgatacagagactactattagcatggcccctgcccaagatagacgcacaaatttgtaaagcattctgtattaaaaaaagttgtttcttgtgtgaattcacaaaggaaaggttaaggatttaatgcttataagaatatagccatattttcattttgcttttcatacttcactcttgctcttaaactccttgcccataaactaaatacatttctagaaatttctaaatattatgtgaaaatacattagggacaggctaaattgttttcttttaaactgtgtgcatatgacgatttgtgtgtcctgttttatacttttataacacctgtgtgtgtccttggtatggcacttactatattgctttatttgtttacatatctcactcccctactagaacagttccctcagtgatggaccttcatattcacaatgactagcaaacagatgaaaattaataggccaggcgcggtggctcacacctgtaatcccagcactttgggaagctgaggtgggtggagcatgaggtcaggaattcgagaccagcctggccagcatagtgaaaccccatctctactaaatacaaaaattagccacgcgtggtaaaaatacaaaattagtagtcccagctacttgggaggctgaggcaggagaatcgcttgaacctggcaggcagaggttgtggtaagccgagatcacaccactgcactccagcctgtgcaacagaatgagactctgtctc

SEQ ID NO: 51266 - DNA, 925 bp, Homo sapiens
gagacagtctcgctctgttgcccaggctgggtccctggtgttttaatcatcgtgaaacagcagctgagatttagaagatgatctcatggcactctgtgaagtttctgcaactctgttgctttctctgttggtcattgcctttcatttttatattctttttttctgataagttgtttcattattgataagtgttaaattgcactgtgtcttgctcccctctataatgaaagctattcttcgcttgagatcacagcttagattttctttgaaattccccaagagcttaacacagggctttgaacacagtgggcatttaataaatccttgatgatgatgttcaagttccacattggtcttcaactctctggcggggtcagaggaccatctgtgctcgctcagatatgtcaactgcagacccagaaagcagccttctccagacaagttgctcctgtctcctgggccgtgtgattcgaggcatgtaatcataatcctgagctgtcagcagggcagtgattggtttccagatttcaagtccatgaaacaggtagccagggttggggaaaagaatatttccgggaagttaggaggcctggttgagtcttggatcttcagtgactgatgctgtgaccatgagatactcaactcacccctggtgggtctcagtttcctcatccataacatgaggagagggacacagtgctctctccggccccccagctgtcaggtctctaaatctattactgtgccaccgtgaggagatggctgtcacgtgagttctgcacggtattggcatgttcccttatacgagggtggctttacacatttgagcatggcaaagtttaagtggcccctctttcaaccaaaaatgaaaacttttcatacatgatttttagcagaatgtatacaaacgaccatcaaaatggaa

SEQ ID NO: 51267 - DNA, 3044 bp, Homo sapiens
  misc_feature (961)..(961): n is a, c, g, or t
  misc_feature (1535)..(1535): n is a, c, g, or t
  misc_feature (1766)..(1766): n is a, c, g, or t
  misc_feature (1840)..(1840): n is a, c, g, or t
cgcctctcttggaaagttgatctccctgcttttcttctcctctgtttcatgccatgaatttcgcactaacagtcctcccccatccagggtccagccagcctcttgcttgctaaggcagaggaatctccctggctttcctccttgactgcattgcagccccttagcctgtgtatctgccatagagctccattcttctctcatttgctccaattatggtgctttttgtctgcctttcttttctcctagctctgcaatactgctcggaagccccaccggccctttcagtgctaccttcttcctcctagtgcctccccactccccactcccagtcctggtaacacttaatggtcagggaggatttcatcactgacctgagtaataaggctatgactgctctgtgccagagaaacatgggtaggggagaagacattaggaagtttaccttcttggtaaaggacctaggcttcccaaggtcccagccctcagcttatgcatgactatcagcacctttactttcttctggctcaccacaaggaaaggtaatctattcctggactaaatcagtgccttgggacagctatagtgctggtgtagggatcagagcacaaggcaaggttttcctgggaggataagtataaccatgtttttcacagtgatcgggcttatagatactattgtctctgacttctagatcatcatccttcttctctggagtagcacaataggcatgtctctctttggacatatacaatgttcaagaataggggtggtgatgggggcttctctgttgatctgtgtgtttgtgtgtattgtcaaataactgttatctagcatttgctatatggtgtggagcactaagtgtgagatctatgtcacacacatacatatataattatatatgtaaaatttcaattctcacaatctgtgaagtactgaggtagatagtaatattgtctgtatnttttaggtgaagaaactgagtctttttccaaagtcacacagctagtaagtgatgggaactaggattcaacacaggaagactggctacagagtctgtgcttgtaagcactatgctatattgctgtgtgtgtgtgtgtgtgtatttcactgatctagttgctgaagcccttatcactgctccaagaagtaatttacttcattttaatttaaagcaaagatgaaaacaacttatcctactgtccaaaacattcttccccttgcataggagaggggtgcttcctgaaaggagtgagaccaagagagttgctctgagccaaaagctgccttgcagtttagctgaggcaggatttagaaatggcgtgaacagtgcctgcattagccgatggcatggagtgctgagtgccagcagaggagataaaatcagacatatgtttggatataaatgttcctctctctcttctaattttaagcccctgctgctttgttgcagtgaaatgatggagccttaattataggccctggccccctgaggtagaagcctgggttgagtaaggcccacttagccctctcccagnctctacccattaccacggaaggaagccagagaccatggactctgaccctcttctcagacaacaataggaattgtcttgcagggactctctgctggttgttccacggcactcagcaagttgctggcctcaatacatgttaaatagccatgataaagctaatgtctctaggccttagaaactagcctatctacctttacctccattgacgataggatgcagctgaagggtgtnaaaaagtcctggagcacattgtagaagtggcagctacagcatggcacttaaagagttagagctggggtagatanagtggagaagaggagcaaaagaccctcccagtattctcattgttgagccgggtaagcaaaaaccactccattatggggaacctctgtggtccagtaggtgttttaagacctcctccacactgcagagtttccaaggctgggaggaggccaagccaccttttctaactataaaacaccaagtcttacctacttcactccttccccttagctgtcaccctctgtgggatcctgcagtttctgtctgccattgggcctaagaatcaggaaatggttatgtagagtcctgatagtctaaccccttagcacatgtggagcccctgtagtcaggccttagagggcagtatagccagttctaaagagagtgaacagctctaagggataagagaacacagacgtatcttaggaaggtctcattttaactgttttgctagttaagtatgttcttgatagccaatagcagcctgggtgagaaagcacattgactcaggagtcaaaagacctgggcttttagtcccacctcctccactagcagtgtgaccttggatatgtcttttaatttctctggggctcagtttctttgactgtaaaatgtgaagggattagactaaatgatttttcacggccttcagttctgtaatgaaaattctctaactccgtatcatcagcaagagtctttacatccaacgtgttgctataactaccccctaaagagctaccaacccgtgttccattcctaggtaacaaaccttggcctggccaaggatgagtcacagcattcacggctgcatttttggtactcacgggatgcctctctgaaaagctgtcccaagtgcctgctacagaggaggatataccatgatagcaaaggaaggttactgctgtaaaagtggaaactgcatggatcaaagggcaggcctactggggtaaggaactctccctgcagctctgaggatacttaaatctaggatcctagtcttagtctcccccaactcctttgaggttcctttcaaaagtccttctcccacagattgaagctgaatatagtcttccttgggacaaatgcatttgtccataggactctttcccgagattgttttaggcccatttctgtacctctcccctcagactgttagccacagacccttagtcattgcaaagttactgcataattccctgtctgctcaaatagctgtcaaaaaaaaaa

SEQ ID NO: 51268 - DNA, 329 bp, Homo sapiens
tgagacagtctcgctctgttgcccaggctggagtgcagtggcacgatctcagctcactgcatcctccacctcctgtactcggaaggctgaggcaggaaaatcacttgaacccaggaggtggagagtttattgtattacagacacttaacttaaacttagatatatttgtgccaatcaccattttttttcctgttccaactttctgatagaacctaaagctgggccatagtgcccagcagtttgggaggccaagatgggaggagtgtttgagcctagaagttcaagaccagcctaggcaacatagcaagaccctgtctctacagaaaaaa

SEQ ID NO: 51269 - DNA, 244 bp, Homo sapiens
caggctggtctcgaactcctttcctcaagcgatccacccacctaggcctcccaaagggctaggattacagccatgagccactgagcctggcctgaataggtacagctttttgtatgtcaattatatcctaataaagtgattttttttaaaaagaagcattattactagagtacacattttcaaatgattgtgataactgcatttcaatgtaattgataacctttgtagtcctgtatattttatt

SEQ ID NO: 51270 - DNA, 1475 bp, Homo sapiens
ggcagcgtggcgcacaaccccgagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 51271 - DNA, 1381 bp, Homo sapiens
ggcagcgtggcgcacaaccccgagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 51272 - DNA, 1435 bp, Homo sapiens
ggcagcgtggcgcacaaccccgagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 51273 - DNA, 1403 bp, Homo sapiens
ggcagcgtggcgcacaaccccgagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 51274 - DNA, 905 bp, Homo sapiens
ttaagtcggacttaaaaggttttgccattatttataaggttcttgggggctttttttaaaccctccccaattgttgggctaattcactgtttccacagaatcattcccacttagaacagtaccctatttttctaggtttcttaggcatacaaaatgaacacaggtaaaggcatttaaacaaaagaaaaatagccgaagaatttgctaaagcaatattcacttttaaaatgcaatttttcccctaaggttcgaggcgtcttgttcgtagccgttgaaagtatttttccatcctaaaaatatctgtggaaatattgaccagaaataaacttttaaatgatctgtgatgtttacaaggatatgtctaaaacgtttattacattattttcctcttaatgtgaattctccacgtttgaaactgtaactcgttttctcattttttgttcttcttgttacttcctcatattgtgtacttggaaattacctttgtaaatacttgagaaattcgttcttatatataattaatataaaaagtttgcatttctcaaaaacatctctatcaaagcctgtgttctcacgagtttaatatcaaagtcttaataaaataatcacaactacccaaatgcttataaaatatgttcgattactggatttttattcattaaacagaattaattttatttgacatatttaaaggcgccatttagaaataaaattgcttattatgttgcaatactgtatctatttcagcctctacaccgttttcttttttgtttcacctgaaactagttttcccttccgttttttttcttgttctatcaagctaatatatatatcaacatacagtaatggggtgctggtttttgtaagttaaatatgtacctgcattaaataaatagtaaacatgt

SEQ ID NO: 51275 - DNA, 416 bp, Homo sapiens
aaacaaaatgagaaccagaagccccgcccatatattgagcaggactctactaggttgaccactgagccaggaagaatggtgaataaagaaagcaatctggtagaaacaaaagaggatggcacttagtgttaggacctgattttgtgttctggcccttggcttagtacacctcccaagccgtagtttcttaccaatagaatgcagttagcagttgtattaacatcatagatttattgtgagaaatgagatagtagatgtgaaaacactttgtaaaacaatatataaatgttagtttttaaaagatacagtacctgtcttttagaaacttatgataaactgtgtaaactgtgaatcataatacatggcagaatgagacgagcgctattataaatgtgaaccctgtatgctgtggaaat

SEQ ID NO: 51276 - DNA, 178 bp, Homo sapiens
ccatgaataggcaacatggaagggagaagggcatatcatcaagaggcaagatggaggagatgatgtgtacaatcaagagacaacatagacagaagaggttttgacatcaaaaggcaacatgagatagagcgtgtgccatcaagaagcaacctggaagggagaaaggtgtcccaattaa

SEQ ID NO: 51277 - DNA, 400 bp, Homo sapiens
tcttgcgttgctataaagaaatatctgagataagttaatttataaagaaaagatttgtattggctcattgttctgcgggcttcacaagaagcatggtgctggcatctgcttggcttctaaggcggcctaggaagcttacaatcatgagcaggcacatcacgtggccaaagcaggaacaagcaagagagagtcagtgggtgtggggagggacatgccacacacttttaaataaccagatctcacaagaactcactatctcaaagacagcagcaagccatgagggatctacccccatggtcaaaacaactcccaccatgccccaactccagcactggagactgcaatttaacttgaaatctgggtggagataaatatccaaattatatcagagggccttccc

SEQ ID NO: 51278 - DNA, 1793 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51279 - DNA, 485 bp, Homo sapiens
  misc_feature (55)..(55): n is a, c, g, or t
agcagggatgcttgaaacagggtgaggaaggaacggaaaccaccaggcctggggntgagcttcaaaagaattccctactaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51280 - DNA, 1578 bp, Homo sapiens
gagtggtgctgggattatgcaggctgaggctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaaccatttctcccccatcatctaaatggaatatattgtgcttataggtattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaaccttgaaacttacatcttggctttaggtcctctgaagtataaaactagtgatgttgctgttattaacaagtcagttttgccttcagtcttctaacttgttttctgtttccttcataattaaaatgctcacttgataatactgccttcctgtaatgattgatgttcctcattctaccagcgtcacctggaggacagtgttggtaagcttgaagaaaaatcgtgcatactggaaacaatggtcttgcctcaaacctgttgagaacttctcttccctgcttctctccataatttgaagaagcaagaaatgtttctgaagtgaagcataaaggagtatcttcaagctctatctcatacctaccagcttgcatagagtataatagtgggaagaaatattgtgaaagattctagaacctaagtcctttctaggctaggcaattctaggctacacaattcgtagtctctgtaaataccatttgataactgaaataaacctataaagtgggattaaatgttagtccagaagactaagtgatttaaggaaagagggaaaataaccagatagatttctggtggatattcatagacagacataatttcatcatgtattatggccctaagtcatctattttatattaaaacatagatggtaactgtaaagttatcaaatgtaaaaattactgggctagcattgtgttttaacactgatacaccagttgattacagtgttgacagaaaacgggca

SEQ ID NO: 51281 - DNA, 150 bp, Homo sapiens
gcggccgcctactactactactgctcgaattcaagcttctaacgatgtacggggacatgtcaatcaagatgggtgattatgaaatgccagacttctaaaataaatgttttggaattcaatgggtaaataaatgctgctttggggatatta

SEQ ID NO: 51282 - DNA, 1761 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattca

SEQ ID NO: 51283 - DNA, 2292 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattaacacaaaaaacaaaaaaaaaaaaaaaaaaaaaaaaaaaaaaaaagaaaacaacaaaacagacaagaaaacagcacaaaaaacacgcaaaaggcaacaaacaaaccgacaaagcagaacacgtcaccccaaaaaagagcaaaagaatcgtaaggagagccacgcgcaaggctgaacctactatcacgactgtaaaaggaccccacggacacatgacaaggacacaccaggcgaaacaccaatatggagagaaacaaatggacccacaggcaatcacagctagaccacctgcacggaagaggcagaatgaaaaaacaaacaaacaacggcaccacgacatcccgtatcgttacataatacaaacaaaaccagatgacaaacagagcctccaaccgacgaaccaaacaacaaggacacgactacagacgcggagtcaaaccaagccctgactaaacagaagcgaggacccacagtaaggcaggacagagcatgaaaccacag

SEQ ID NO: 51284 - DNA, 2501 bp, Homo sapiens
gagtggtgctgggattatgcaggctgaggctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaaccatttctcccccatcatctaaatggaatatattgtgcttataggtattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaaccttgaaacttacatcttggctttaggtcctctgaagtataaaactagtgatgttgctgttattaacaagtcagttttgccttcagtcttctaacttgttttctgtttccttcataattaaaatgctcacttgataatactgccttcctgtaatgattgatgttcctcattctaccagcgtcacctggaggacagtgttggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51285 - DNA, 1926 bp, Homo sapiens
tgatctgcccgcccttggcctcctgaagtgctgggattacaggcataagccatcgcgcccggcctgttcagagtatcttttgcagaatggctgaagctcgaggttttcttcttcaccattatgtactgctgctgtacaaccttttcataattatccttagtcccattcctctaccaaggtgaaagcaacatcttatcagacccgaattatgaatttctcaagcccctatgattttctgttttgggtgccaagtatttatctcttctgttagactatagtctttcttcacatagggttcatgtctatattggttttatccatgggtggtttttattctccagagtgactgacctgttcgtaattccgttcttgagaaggattgttgattatgttgaagggaaggcttcttaccaagattttcagattttgctttcaatgtttatctttttggggttttgcaggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51286 - DNA, 2350 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagagaacccacgcgtccggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgagggagtgaagaaaaagggcagtgaagaaattatgagatatccagcaaaatggcaagtcaatcgatggaaagaatcaaacatcatcaaaccaagatcaaaggcagaatccttcagaaacggaaaaatcctaaaaacaaggacttgtcggtggagaaatatagcaaagggcagtttaaaaggctgtagctggcaatgtattagcccgatgggaagaagaggaacattccctgtggtctacccacagtctttttatttccctctttgcccccttgtgaaaacgttcccttctggtgaaaccttttgttgcgcacaagtctgatataaaagggcccactctaattgcctccgcctcacatcta

SEQ ID NO: 51287 - DNA, 1646 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagacaagtatcaaaactttcagtcgagcggccgcgaatttagtagtagtaggctagtagtagtaggccgc

SEQ ID NO: 51288 - DNA, 1747 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51289 - DNA, 1853 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgggtcccctttgggcggttttcccctttttccctttgggggctttttggtgaaccaaagggcttttccctggatcaaggaaaaccttgtcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51290 - DNA, 1302 bp, Homo sapiens
agcgtagcaaggactatacaagcgtatgcggactgagccgtcgtaattgcatagtgtcgtgactggttgaaaccctcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51291 - DNA, 1745 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaattctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 51292 - DNA, 340 bp, Homo sapiens
ctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattattatctctgtttggtcttgat

SEQ ID NO: 51293 - DNA, 1178 bp, Homo sapiens
gcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcatcatcgaaggcttgtttggctaagaggcaggcttgctcaggtgcattctggatctcatagtagaacacggagaacgctgtggcggccg

SEQ ID NO: 51294 - DNA, 3274 bp, Homo sapiens
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 51295 - DNA, 3205 bp, Homo sapiens
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 51296 - DNA, 3236 bp, Homo sapiens
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatgtggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 51297 - DNA, 2516 bp, Homo sapiens
tttttgtcagtgtgttaatgaatgttttgttgaacccttttcatctatcaaggactgaaatatctgatttaatctcagtggtgcttaaaataaacttttgtggctgagtttactcaagcccttatttgaaagctattcttataggcaggcccagagctaaagactgccagcttgttggcccactgctgtctgttcctgggggcacattgggagccgtcgtcaggtttcttgacttggacttctgacttactactctctggacagtctggagagtaggtggatttcagttcagttatttttgattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 51298 - DNA, 3428 bp, Homo sapiens
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgttaaaaaaaatcaaaataaaccctcccaagcatt

SEQ ID NO: 51299 - DNA, 2331 bp, Homo sapiens
  misc_feature (1502)..(1502): n is a, c, g, or t
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagaccttnacctccacccggacaacccattccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 51300 - DNA, 1206 bp, Homo sapiens
ccttctttctcgtccctctgaaggcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 51301 - DNA, 2774 bp, Homo sapiens
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactactttatcacaggggaaacacgatgtgaatgtgcaacgaacgtggcaagctatatgatttctcctatgaggcagagatcaaagtgtgaggca

SEQ ID NO: 51302 - DNA, 1029 bp, Homo sapiens
agctgaaactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactggttagttcaggaaaagacggtctgtaccgtgatgacgttctttagagccttgctctcttaagccgtcattgtttgtgatttagcatatcactctttccttaatgctccatcaaaataaaacatgagctgaagatactataggaaggggaaaaataagttattttctacattaaaggttggcaaactatggcctgcgagttaaatctggcccactatctatttttgtaaataaagttttataggaacacaaccatgtccattc

SEQ ID NO: 51303 - DNA, 218 bp, Homo sapiens
ggaatatgaagtaagcccgtcaaaattgagtagaaaaagtgtgagaagcagtccctgacatctggtaggggccttggcacttgcaggaaggccttggcattctgttgcacataaacaattgcacagcatgtcaacagcagataagactgctctgactgtggtaatttctcctaccttacagataggtttactaagattcctggtcatagaattgcacc

SEQ ID NO: 51304 - DNA, 381 bp, Homo sapiens
tggggaatcattattttaagaactcttgttaaaaatgttatattgaggaaaaatggctttcatttggcattcccacatatgtagaaaagatgaaaatatgtctataaaggtatatattatacaaaacttcgtgacaaaaaaattgaaaggctggaggaaatgaatattattttcatacataacaaattctcagtaaattaaatcttttatctcatctcaagaaaacaaatgtgaatgcaagagagcaagagacaagttattataaggataaacttcaatctaatctactattatttctttctttaataagtctatcgcagatattagaacttgaattcttgtttatatactgagtattctaaccatggtgcaattactttg

SEQ ID NO: 51305 - DNA, 159 bp, Homo sapiens
  misc_feature (4)..(4): n is a, c, g, or t
  misc_feature (7)..(9): n is a, c, g, or t
  misc_feature (11)..(12): n is a, c, g, or t
  misc_feature (148)..(148): n is a, c, g, or t
  misc_feature (150)..(151): n is a, c, g, or t
  misc_feature (155)..(158): n is a, c, g, or t
tatntannntnnaggaccagaccagctttcaaaaagaaaattgttaaagagagcatgaaaatggttctatgactttgcctgatacagatgctacttgacttacgatggtgttacttcctgataaactcgtcgtaagttgaaaatattntnngtgnnnnt

SEQ ID NO: 51306 - DNA, 181 bp, Homo sapiens
gtggcttcactcttgtcctcacccctagacatttactcatgggtgagggcaacggggccaccttggtgcaggaagtgagtgttgatggatggcagggagtgagcccttcaaggaagagtagagctcctgggggctccaggcagggtcatgagggctcatggaatctgtatcaaggacccct

SEQ ID NO: 51307 - DNA, 305 bp, Homo sapiens
ggggctactctccccaactcagacaaaagtccttgaaactctccatttcctttaacagcaatttcccacactggaccgctgaagtcacatcttggcttcatcctaacaattttcaattcttcagattcttttgtctctttcactttttttcccccatatccttagacttgccatttaaaagttgtctttgcttcaagatttttccataccgttcctccctgttagcttcctctccctttctcctttcactaggctctcacagacataaaatggacactaaaactctttttattcaagttttttac

SEQ ID NO: 51308 - DNA, 312 bp, Homo sapiens
taccaaggtgatgatagtgagaagtagagagcctaagtattcatatcagagagtgaggtgaaaactcctgagcgtgcccctaacgaagtactcagcctgtccttagcccagtgaggtttctaaaatgctaatgcggtagtaattctcctgttacagggccatttctaatcatgggaaaggaaggggagccacctatttgtgctcttaggcgactgtggctcaatttccagccctgaagtcaagaacagccaggaaaagggagcagtctcacaccgagggtggtgtgcactgaaatacactgtggccagtcag

SEQ ID NO: 51309 - DNA, 446 bp, Homo sapiens
ttgcatcaaataaataccaaatttgaaaatagaaaagcattaaaccaattacataggtgtccactttaggttttcttgaatgtcctgagaatggaaatcatatcaaacaaattgtagtgaaactttatagggtcattttctttacatatcctttccttttcctaaagaaccactcctgtttttccccttcccaaatctttagttctctagccctcatttcccattctcttttgctgcaatccacctgtctgaaccatttgcccaggtctaagcctctgtctttgcatctcagccctgcctggtacctgtccagcaagggactggaagctgctggtaagaaaggttgcttctccatcagcagtcatggaggagaaggcggatctaaaacattaagacatgccccctcttatctgtcacatcatgcctcatatatctattttataaca

SEQ ID NO: 51310 - DNA, 406 bp, Homo sapiens
aacttgggaggcagaggttgcagtgagctgagattgcacagctgcactccagcctgggtgacagagcgagactctgtctcaaaacaattggacttaagatggcatgtctttgttttagggccaaaaatgaggcccccttgcttaaggcatggggtccgtggccaggcaacggggtgggactgctgccccagatgtggccatgggggtcgtggtcctttcaacaccaagctatgagctgtcgccatggagaccagggccacctgtggaaaggcggattttgtctgcttttgacttttcttttttaatatgtaaaactccacatcagcggaaacccccccctacttctggcctggagcttcagggttttggtgctgggacgagtttgttgttctccttagcggggtgg

SEQ ID NO: 51311 - DNA, 616 bp, Homo sapiens
cttttgatttaaaggatccatgtatgaaaaccaggggatgacctgtggtattatgtttttgcccacaattcctggcttgtaacttccatagcccttgttacagtcttttgttgtaatgttgagtgtgtcaggcctcaggagcaggcctcaagaaaaacaatttctctgaccttctcctgccctcctttcacctgccccaaggcaggactctaatgtctgcccacttttctgattgtgggtcctaagaccttccccagagagagtcttgccctataccttgggggaaggaatgctgacattatgaagcttccataaaaacccaagaggaccgcattcagggagcctccacatagctgaacacctgcaggttcctggagagtggtgcacctacggagggcatggaagctctgcaccccttcccccataccttgccctatacatccctttatctgtttccttgaaataccctttatcataagccagcaaaattttaaaaataaacaatcctggaggagtaaaataattcagtttccagagcttccccagtgtaaaacttggaatgttcagtttccaacaaaaaaatacaaaacatacaggaaaatatagcccacaggaa

SEQ ID NO: 51312 - DNA, 1252 bp, Homo sapiens
tgataaaattcattaaaagcaggaagccatagggacttcacatatagcttcctgcctctcacttgcatagttacttacctgtgatggccagctgagtcacaaagaaggtcattcttgacttcttctttctcctccatgtggaaaaaagcacaacggagtttccaacaatggtaaaaacaaagaggacccacagagttatcaattgctcagtctgcaagaaacagagaaaaataaaaccagtgtaccagtgagaactggagttctttacagaatgcctgccccaggctggatttcttcctcctagccacatatccctacttttggaagctctactctcaagaaaacaatgacaaaatggtcttcatttacaccagctgcagagtaaattaatgcaccttttaaaaatcttttggaaatatacgtcaagagacaaaaagtttgtattctttggtcaggtaattgtaacactatgtgaaaagtaggtcaagatgtgaaaaagaacacccctgtcagaaatatgtccatgtttattataaaaagaaattagaaattgtttaaagataatagggtagctaagtaaataaagcacttcaattcagtgaactattacagcatagctattaacaatgacaaccatgaagactatgtagcaatattaaaaatacctataatggtaagtgggaaaacatgataaaatcatatactgggtatgattacaactctgtaaaattatatacatagcaaaaaggctgaaatacagtaaaatgttaaaagcagtcatattagggtgtaattatgggttatcttttgttcatttgacagaattttataagacagtaatattaaagttctactgaagaatgtttctgtggtttgaatgtgtcctccaagggtttatatgttgaaatttaatcccccaaagcaatggagttaaggtagaacctttaagaagtgactaggtcatgaaaggctctgccctcatgaatagattaatgttgttattgtgggagtggattagttattgcaggagtgggttactgataaaggaatgagttcagttcccctcccttgtccctctctcaccctctcactttctgccatggaatgatgcagcaagaaagccctcaccagataccagcaccttcccagaccctggcactgtagaaataaattacttttctttataaattactcagtcttgggtattctgtcatagcagcatgaaacagattaagataaatgattaattagt

SEQ ID NO: 51313 - DNA, 233 bp, Homo sapiens
ccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgcc

SEQ ID NO: 51314 - DNA, 239 bp, Homo sapiens
gggcctctccacagagctgcttgaatgtcctcgaggcatggcagctaattttcgacctagcctcagaaactatacaccattactactgctgcattctgttggtcaaaaggcaggaaaaatgcatctcaccttttgataaaggaatgtcaacatttcattgtaaaattggaaaataaattcccaaagtgcccaacacttgtatagcactgtacggcttttttaaaatgccctatttttca

SEQ ID NO: 51315 - DNA, 651 bp, Homo sapiens
  misc_feature (490)..(490): n is a, c, g, or t
  misc_feature (512)..(512): n is a, c, g, or t
tgtagaaatggcatcttgctgtgttgcccaggctggtctttaactcctggccccaagcaatccctgactttatggcacttgctcagcctggtgtgacagtgtctgtctcctggaggccaggagcccctggcatgcagccagcatgccccatttataatcgtagcccagcacatggaagggacccaagagaatgacagcaacgttggctttgccatttcaaccctgaacctcattttactgttctattcatattatctgggggacaaaattttcccacattcctttctgttggtgccaccatctctgtgcctccgtgtgctgctgacctgccaagcccatggccagctcagcactcggattttatttggtctctcggtatgggttcctttatcagcatttcaaaaagcttttgtgttttatccataattgattaaagtttgtagctgtgaataaaagattgattaaaagcaacaacagcaaaacatatagnggggggcggggacaaattttgncctaaattgggtttctttaggggggccccgcgccccaattcccccctaaggggggggaataaaaaatccagggcccggttttaccaccggcgggaactgggaaaacctggggggttgcccacttaaaataggttgggag

SEQ ID NO: 51316 - DNA, 475 bp, Homo sapiens
ctggctgtcctcttctgtaagaccctgttctccctccgcacattacagccctccctggaaagtcctctggtgggcgctcggtgtctagctgctgccaatgaagctggcttcattttggtctccttggaaccagctggttttcccatccttaccctaggcctgggccatcatgtttaagctccagtgaaaatgtcaaaccctgtaaccttcctgcaatatgttccctgagggcagtgtgactccttaagttgagggaatgtgtcccagacatgggaaaagcctccgagagccccgtgcctccagaacacgggacatcgtggcctgtcctttgatggcattggcttcccatggtagacctgagcacgtgcatcagagatgggtgagccagaggaccctggactctgatctcctactcaagcaggggacggtgtaggggcagggcacaatgacattggcttgggaaattagccaaaag

SEQ ID NO: 51317 - DNA, 670 bp, Homo sapiens
caatatatgcaaattattagtgagatctaaaattattcttcacactaagaattcaaaactcactgtgtatctggttatagcataatttggatgctaacgtttcatcaggaatacttgatctgtatttagattttgtaaaatatgcagttgaaaaacacaaattcatatccaagttgttccaaagatagttaaacatagtaaagtttttcagtaactgaattgaacatcaagtttgaaaaaataaaacccagttccttagtcatgctaaccttatttcaggtgctcaaagggcccatgcatctagtgctgctgtcccgggacagagcggctctaagtgatctgcttttacacgctttatggtccgactatacataatcctcccattagtaactaaagtattggccaataaatttttcccaggcatacattaaacattcacaatactctgtggccatgtttaacttgggagcaagtagtggcaaaacctcctatacaaaaacgtgaccacacctcattcatgcctttgtagagctaagcaaaatgctttagatcaaaaattgccttgaattatttacgttcattgtaatctctcctctaggcctttgtgtgttttgatagagttcgtttgaattggctcaataaatcattttatttgctgcaaaaaaaaaaa

SEQ ID NO: 51318 - DNA, 432 bp, Homo sapiens
gtcctgatcgtggtgatggtttcatgagtgtacacacggcagaacccctcaccttgtatactactttaacgacgttatttattgtgtgcaatcatacttcagtaaatctgttacaacacaggcacaccccttgggtaagtcttggctccaccatttatctaagtatgggatcttaatctccgtggactgtggattactctgtaaaatgggaatgataaggccttccctgcccaccccataggagtgttaggaacatcaacatgagaaaacaacagcaccagcaatccaggtgtgtatacattcataaactcacaaatgggtttcatctcctttaatcactgtcgacaatgaaatgggtcagtgctactgctctagggcctggtctgttgtcttgcccacggtcagtctgcaatgtttattgaattgagctga

SEQ ID NO: 51319 - DNA, 520 bp, Homo sapiens
gcaggatgcccctttgtgctggaagtcagaatctccatgtgttcttctcgctgcccgccgaggtctgagcggggccctgctgtgaatgaccccgggaacggtgccagagtcacacagacttggtgcagacaacagagctacctttcaggggctctgtgtccttggacaggtcactagacttctctgaacccgttcgctcatttccagaaagggataagatctctcttacagttcatggggtgcgcaagaatgatgggtgccaagcccatgaccccaggttctggcaaggaatcggcctctccaaaaatgatggtttttattattctcactattctagaaaatgtctttgtgaattgtttgcttgattgaaacggtttctttttaataaaatcttgattttaaaaagcccgaagtcacctctgttttctttattcagcagaataggatgcggggcgaggacaacatttagagacttggtaaatgtttttttctttaacttacattgccgtgtgtgtgcgtg

SEQ ID NO: 51320 - DNA, 288 bp, Homo sapiens
gaaaaaagcatagaagacacacaccaaactgacgattaaggatcagagaggaagggaatgacttctacttttcactttaaatacgtctgtgctgttttcgtgtcttaaaaatagcatgtctttatactagaaaataaaataaacgactttattaaaatgtaccccacacaaactttagtgaatagtaacatattatagtaacaaattttgtaattagtaacattaaagtttctaaatgcacatttcattcattcattctgtaaatgtttatggaggaactactaaggg

SEQ ID NO: 51321 - DNA, 301 bp, Homo sapiens
atttctggtcccaagcattttggataaggaatactcaacttttaattgttgggaagcatctgtttcttttagcaattctgtgctgcacagaagccccctggccccagttttatgctttgtatgatttgtttttcatccttcctatcgttacttctctgttatttagtctcagttttaaaacattacaactagtgagaacctgctcatttctaaatgttcaaaaaagagggggaaatatcatgatcacttttcaatagcatgaaaaacaccagctatttttaagctgcttagatgcaactga

SEQ ID NO: 51322 - DNA, 494 bp, Homo sapiens
ctctactctcgcagagcggaggtaggggaaagacgggtatattctgtactgtctctcaattcgacagacgagcagctgcattctaagacaagctttgagaagacaggatcctgggtttgtcaggcaggagtgcccttggcctgttaagccccgtgtccgctatgggctatgacagggggagtgcctagctccagctcgattttttgaccaagacactgggcagaggttttaggcttttgcatcttgacgtgggagatagagagcctgtgagggagaggcaccagagacggagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacacaacagaatcacaaacttacggatttcta

SEQ ID NO: 51323 - DNA, 329 bp, Homo sapiens
gttacacatcacgaagtcaaatgccaggggaaaccattagccggaatctacaggaaacgagaagagaaaagaaatactgggaacgcagtacagagcgccatgaagtccaagaaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacacaacagaatcacaaacttacggatttcta

SEQ ID NO: 51324 - DNA, 946 bp, Homo sapiens
gaacatgaaatccccaaggaagcacgttccaagctgagtaagaatgataagggttagatgagttgtcaattgcttcacagcatattatgccaaatcctagcctcttaaacaatgagcatgtattatcttacacagtatctgtgggttctgaatctggaagtaaattggctaggtagctctggctcagggactttcatgaggtggacaatccaaggctgagaataccaagaagggtgatcactggggaccatcatggaggctggccaccacaaaaactctgaatatttctaatctgaaaggcagtatttggtgaaaggacattagccttggagttacttggatctatatttgaatcacaactctgccacttactgcgccaccttagccccattaactaatctttctaaattccagttttctcatttgtcagatggggctaatagcatctagcttattggactattctgaggattaggtacagataattttggaggctggcaagttggaggcactgaagaattgttatcactatagctacaacataggtgaattgtcactgtaaaaacacagttggaagtcattatccacaaaaccttatgtcaaattctaaggttttgttttacctatttgttttattatcacccatatattcttttataacctagtgagagccaaacaaagggaaaacgaaaggtgcatgaggctttaaaaaattatttacttttatgtatttggatacatgtaaaaaccataagaattttaagggccaaacttgaagagtcaaaaaactgtcaagctatttcagttctcccatatgactgaagtccatattttgatgaccttaagtaaacatggaaataaataaataataataaagaaaatagaaggggaaagaaaaaccaccaatactgagctaagtgggtttcttaaaattttaactcttctg

SEQ ID NO: 51325 - DNA, 363 bp, Homo sapiens
  misc_feature (355)..(361): n is a, c, g, or t
  misc_feature (363)..(363): n is a, c, g, or t
acaggttatgctgtgagatgcagaaaagggattctggttactttgggggcagattctgcaataaaagcgcagatactggcaagggctccaccacccagggaggaattcatgataatggcataaagcatggcaaaaaagaaggaagaagtagaagtatgtctaaggataaaagtgccactttgatcaaaactattaaaaataggtaggaatgctgaataaatatgaacttagaccctgaattctcattttgggcgtaatagacttgaaatggccgctgaaattatactatcaatgaaatgaaattagtcatattaaatgtcgtaatcatttaatcgtattaaatataccaatatannnnnnnan

SEQ ID NO: 51326 - DNA, 351 bp, Homo sapiens
atggagtcttgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttttcaaaaatgatggagaggatcactatgatgatgaatgattccactggtcacattattgatagagcaatcagtaaatccaggcacatcctcgggatattactgacctcctattattaaaatatgaaaaaatggagg

SEQ ID NO: 51327 - DNA, 392 bp, Homo sapiens
tgtctcacacatgcgaaggagggcctcctttgtcttgagcatctgaccctggagcctctcaagcctgcactgctgcaaaaacagaacgactcctcaatgccttttgactctggctcaccgaatgtcttgacatgttcagcatcttgggatgaaggaaatacataggtcaagacatccctggcattacaatgggctagggttaggttttttagcagtgttttctttttatataattattttattttatttttaagttccatagtacatgtgcaggatgtgcaggtttgttacataggtaagcatgtgccatggtggtttgctgcacctggcaacccatcacctaggtattaagcccagcatgccttagctctttttcttaatgctcttccccc

SEQ ID NO: 51328 - DNA, 354 bp, Homo sapiens
gaaaaggaggaagaaccttagaaattcctatcttcttccatcaaacagcagtttctcttcagctcttcatagctggaaatgtgatctttgtagccatatcacgtgataacagaattcttccaaagagtactatttgtaaaatgtgcccctaatcttcttgttggtgacttcctagcccaaatcagacctattatcagagctcagtttcattccagaaatatttatatatggtcttttgaaaatctgaggctgtgcttggaaaaagtttgtataatttgttgttgaacagtttcatcttatgtaaagtgaagatcgtagaaatcactcatgaattaaggaaagaatccttcatta

SEQ ID NO: 51329 - DNA, 1901 bp, Homo sapiens
agccagctgccgagtgagaagtctgactatccggagatggcggtgagtatagagaatttctgctaggtctcctgtgtttcagccatcccagcccaggcaccacgacacattatcaaaggactatcttggaccttctcatcccagcaaacatccaatggagaagaatgaagactccaggcatatgatcccactctagccatcccaggagcccccagctatccaaacaactacagctgtggccaaaaacatcgtgtatcagggacaaactctctgcttatggctgctctaatccttgacctacagaatcatgaaatttgtggatacggtcatgatcttgattttggcgatggtttcacagtaactcatgctttcaaaatatcaggaagcaaatgagaaaaggaaaaaaagacattcattgtatatgctgtgaagtaatcctgccaaaggacactttgggctccgcagtgagtatattttttccttaaaaattgccaatttcttgatctatattctatgataaaagttttaatattttgctaagttaattagtattgcctattgaccaacatgttctatttagtgtactgcttcaccaagtgccaacatatacgtctccagtgactgctgatggctgagtctccttatgttagtaaatttctaaacatttttcttagtacatggagtaacgtgttatgttgatcaatgtttgatgacacttaaatgtaactacaatgcagtaattcgaaggtaagaaaaagttgccatgactctcatttctttgaaattgtgtacaatgaaaggcttctcagcatgataccccaactaaaatttaggcgtatgacagcacttataagtaaatccattttatttgagtaaatattgagtttcatttaccttttagcaaattccgaagtagcatctccataaatttaaactgattttacttattgagtcctattactaactttaaaagacaatctactttggatcattttgagcatcacatattgcttacataaaataagtttaaatctgagtcaataatgatactaagcaaacaaataaaatcattggtcactgtattaagtctgttttcatgctgttgataaagacatacccatgactgggcaatttacaaaagaaatgtttaattggacttacagttccacgtgtggctggggaagcctcacaatcatggtggaaggcgaaaggcacatctcacatgatagcagacaagggaaaagagcttgtgctggggaactccttttttaaaaccatcagatctcgtgacacttatctactatcagcacgggaaagaccttcccccatgattcaattaccttccaccagtccctcacataatatatgagaattcaagatgagatttgggtggggacacagcaaaaccatatcagtcacctttggagaatactagagaattaactaactattctgaaaatcagtaattaaagggaaagaagcaaacattttttctgtctttccataaaaaattgtactttgaacaaccaaatgggtgataatgaaagaaagttcctctttataaaagtaactgaagaggccaggcgtggtggctcatgcctgtaatcccagcactttgggaggccgtgatgggcagatcacttgagcccagaagtttgagaccagcctgtgcaacatatctagaccctgtctttaaaaagaaagaaaaaatttaaaacagtaactgagcatcagctattgtgggcacactgcctatgggtagccctgctccacaaggagcagttaaaaaaaaaagtaactcagtagataaatgagaaaggaatgataattacaataacaagatgtggcaatcctgatttaattaatgaatctaagcaaaaagcaatggctttgaatagaac

SEQ ID NO: 51330 - DNA, 493 bp, Homo sapiens
aactccagacaaacccaccatcctctctccattctgttcctgttcttctctcggttaatggcatcgccaaccatccagtccccttccctgcagcctaggagtcatggacttctccctctaaccatttcatctctccctatacaccccagtgtaatcagtcacaagtgtggtattttatcttccaagtatttctcagacccatctcgaagcgcagagcactgtatgctgtaatcatgtcagacagctggcttccctcacgctctccgcgacttctctgtgtccatgtccatgttcctgaagtgcctatgccgagcccgttccccaggccaagtgctttttccttgtgctccctgtcacacacccaggcccatctcccacctctcagcagtgtcttcatcctttaaatagaggtcgggatggtagccacctcgaggagttaagtattacattgagaagacacacttacacaatgctcaataaaagttattataac

SEQ ID NO: 51331 - DNA, 841 bp, Homo sapiens
caggaggcagaggttgcagtgatctaaaatggtgccactgctctccagcctgggtgacagagtgagactctgtctcaaaagaaaaaaaaaaaaaaaacaaatcccaaaagaaaaatctcatttcgctatggcagctgaaagtctgtctatctctgtaattgcacacctttcaacatgaatgattgactgaatatgctctgaataagtgcaaaggatgaaagagaaggttgcaatagaaaagccttatgcttctactacctgtttcctttcctagctcaataaatcaggatcttccatatgtccagaaattcatttctgctttttctaggcatatgtttattttgtatgccttgagataagacctctttggttacagtttagcataattgggaattttagtttaataatatgagactacaattcttcaatgaagacaaactcagaaattcagtatctttgttcacattcttctgtatactttagtctcaacagagatgggccataatctgggtccaatttcactaggaactatgtctctaaatttggttgctttcagagaatctctcctctgtctccctattgcaggtctctaaaaatagcaaagactggtaaagagctttatacttttaccagatggtatctcactgaacccccaaacagacctgtaacatttttaggagggttattacccatttgataaaaggaagaaattaggaaaggctaatcaacttgctcaacacatccaataccaacagacctggaatttgaaactaagacaaaatatgttatcacactctagaagccttcggcagtgatggtactgataaaaatagacaagaca

SEQ ID NO: 51332 - DNA, 647 bp, Homo sapiens
gaaaccttggatttttgagtacccttccacagtgtgttgactgacagtgcctctgactggtcacaggaagtagttatgcaatactcattatatcaatctaaattgtatttcatgattctaatgccctctttttaggctatcattcattgcacctcccaggttgacatgtccagtgaattgagaccagagaggcctttgtgtttgtcctgaattcataatagagtctaggaattttaatagctagacctgtgttcttgccctgaaatggcatatgaccattaccaagaagctgctctaaataaccttcctgcacgttgacccttgggaaaagaaaatttgaaatattatctctcttgaatcctattcctgagactagaactttacaaatttgtattctacttaatgtcatatctatattttttaatattaagattattaacttagtttaacacagaaaaaacgttgatgttccagggaaggtgcaccctatttagcctacggtttctcgtatatcttgggaacactgaagtgtaacacctgagggctgtgtaaacagaggccagcctgagaagctgaggaatcaaggaatttggatggctcaacccataggattccctcttactcacacttctaggtttgtggcagag

SEQ ID NO: 51333 - DNA, 658 bp, Homo sapiens
gaaaccttggatttttgagtacccttccacagtgtgttgactgacagtgcctctgactggtcacaggaagtagttatgcaatactcattatatcaatctaaattgtatttcatgattctaatgccctctttttaggctatcattcattgcacctcccaggttgacatgtccagtgaattgagaccagagaggcctttgtgtttgtcctgaattcataatagagtctaggaattttaatagctagacctgtgttcttgccctgaaatggcatatgaccattaccaagaagctgctctaaataaccttcctgcacgttgacccttgggaaaagaaaatttgaaatattatctctcttgaatcctattcctgagactagaactttacaaatttgtattctacttaatgtcatatctatattttttaatattaagattattaacttagtttaacacagaaaaaacgttgatgttccagggaaggtgcaccctatttagcctacggtttctcgtatatcttgggaacactgaagtgtaacacctgagggctgtgtaaacagaggccagcctgagagagaaaaatccacataaaaaaagggggtggagaaagtccaacaaggctggaaaaaagaataaaaaggggaatatttgggaagaaaagg

SEQ ID NO: 51334 - DNA, 486 bp, Homo sapiens
gacagggtttcaccacgttagccaggatggtctcgatctcctgaccttgtgatatgtccgccgcagcctcccaaagtgctgggattacaggtgtgagccaccgcacctggcccagtgtttgcttcttacagaatgattgcaagccccccttgcagtcctgcctgcctttctaaaaaacgtgcattgagtggcttcataaggaaatccagagaccttggttctctgagtctgatgcagctacagaagctgtgcagatgcgggtgtggaattattttaccctaaaggacccggttaacactcacacttttgcctaaatcctagactggaggcctgaagttttcagttcatgaaattagacaaggagctggggttcattccaagtttccctttgcccatgaccctggcattctttcttttgacatccaaatagacactcccttggcttccattcaacagaaaattggcatcctgaaaagccagataaaa

SEQ ID NO: 51335 - DNA, 384 bp, Homo sapiens
  misc_feature (1)..(1): n is a, c, g, or t
nttttttttccaatgtagaaactctttcctcaatcttttcattgttacagttggaaaagattgaggaaagagtttctacattgattgtagcatccaaggtgtgttctggggcaggttttgagtgttaaaaagttttatccaatgcttaagaaaagacattcaccttcagcacatgcatcctgggccattgtccctactgccattatcctgcaggatgctgtggggtattctctgggtggccacttaggaatttactgtatttgtctgggtgtgggtgggctcatgcttgtaatcctaggaactttgggaggccgaggcagggagattacttgaggtcagggagttcaagaccaacctggctaatgtggcaaaacctcgtctcta

SEQ ID NO: 51336 - DNA, 1046 bp, Homo sapiens
ctgtagccttaattgaaatcccctgatcatgcacttgagcagctgtgcttgtctttccatgttggcttcaatcaaacatagatgtgcatcttaatgggagaagggatagtggattatgccacagtccccttccaggtttacagaatcttagctagtgactccagcaaacacagcaaggttcattttattcttaagacagatccctgttacagtttgctttgtgagccaaggaagacaaatactgattaaccatcccaaagaactaatgagagtggagttggagcgattatccaactgctccaaaaatgtggggattttcttccaaaagaaaaagatttttaaatgttgacacatttccacaatgcatatcaaatgtgcatttatattaatttgtgtctgtgtttatctgcatttctaatattcaggcactcaaatagtatctgctactggccaggctttgttttaggtcctactgatagagcagtaaacaaaaataaagtctcttcccagggagcacacatgtaagatggcacatatttgagtggaggcccaaagaaagtatgagtgctaacccatgtatgtttgagaaaaaagcattccaagaagagtataaaggagcaaatacaaaggctgaagcaggagtatgctgggaacacaaaccattgtggctggaataaaggacggaagaacccagattctctgaggccttcacccacactcccctttccctgcaagcacccacaacaatggctttgatggtacctgatggtcaattgagaagccaaaatgtatatctgtgctattaatggcaacattttcatggagagactgcaagagtctatatgtgtttcatccttatttgaaaaggaatccttgactttgttaggagctctatatatctcctctcatagaaatgccatatattatcaggagactgttaatatctcatgtggaggacccatttgtgcaagcatatctttaaaattaaatattttcaactattgaacatattcatatttttaaataaaggctacagtaaaccatta

SEQ ID NO: 51337 - DNA, 1911 bp, Homo sapiens
gacaagttgaagacccttaagggcctcacagcctagttaagagaattcataaacaggtgagaagttaaaagtatatcagcaggctaagtattgaaaacaatattaaaggggtaccatgcaaaacacgatgcagcaacaaagaagatatgcaggtaatcatcacattttcttttagaaattcagggaaaaaaagatgtcacataatggcatcaggctcaattggaaagggaaggcttttgaaaataagaggtccggtaagaccttgcctctgggtcactactggtatagggagaaacttgctttaaacagtcctgacataaagtgccttttgacatcaactattcaatacctttgagactcacttagacaactggactcattgtaggttccacagaaaaacacggacaacattctagttgtcactccaaccagccacactaggagggcacagcctctggtaccctttctgttcctgaaggcatgtacagcggcttctacagcaagcttgcttacctcccaggattcacctcatggtttggacactgattcctgagagagccttgagacacacaaagtgaaaaaaatgtcaagcaggaatgaaagctctagttttttgcttgttggtatatgtaaatttgtttaaaaagtatccattctgtcgttggtagaagttttgctttggttgataatagagattctgatgtactcttataacttaggttttctcagaaattaagtagcattgaagatcaatgtaatacagttttaagcaggtacactaattatattattgattctatagaaaactaaaattatagatgaggtatcaggatccattataggttgtaaaaaaattcatgttcttcatagattgagtctaatatttcttctatagattgcatctaatgttcctactacctaaattattacgttcaaagttttgaaaattgaacgaaggtatttttaagtacttaaaacatttctctatcattctgtattacatgtataattataagatattgtttgcttcaactagctgtactttgttttcctgtgaagtttcaacttatgtgttatcgatttaacttaattgttccatctagccatgtataatggaaaaaggaagttaatatttgttattgtgttctatgccagggactgtaccaaactctgattggtacattatttcatgtctcataactctgggatctaagtattgtcacaaagagactaaaaatgagagaaaaaattacttgactaggattatgtaggtggtaataatagaatcaggatttaaactcaggacttcagatgccagcatcaatgatattctctcactggaagtggttctcaaagcaaggtcctgacaaaagcatcagcgttactggggaacttgttagaaaagcaagttcataggctgggcatggtggctcatgcctgtaatcccagcactctgggaggcctaggcaggtgggtcacttgagctcaggagttttgagaccagcctgcacaatgtggtgaaaccctgtctttactaaaagtcaaacaaattagtggtgcatgcctgtaggcccagctacacgggaggattgcttgagcccaggagactgaggtgcagtgagccgtgattgctccacttcattctagcctgagcaacggagtgagaccttgtctcaaaaacaaaaaaacaaacaaacaaaaaacaaaaagcaagttcccagaagagaaaaaagaagttccagacctagtgaatcaaaaactctgagcgtggcatctcacaatctgtgtttttgtaatccttccaggtgactgattcatgctaaagtttgagactcattgctctatgccagtcatcattccctttgctcaggttagaatcatctggagagcttataaacgtccccatgccca

SEQ ID NO: 51338 - DNA, 1485 bp, Homo sapiens
gacaagttgaagacccttaagggcctcacagcctagttaagagaattcataaacaggtgagaagttaaaagtatatcagcaggctaagtattgaaaacaatattaaaggggtaccatgcaaaacacgatgcagcaacaaagaagatatgcaggtaatcatcacattttcttttagaaattcagggaaaaaaagatgtcacataatggcatcaggctcaattggaaagggaaggcttttgaaaataagaggtccggtaagaccttgcctctgggtcactactggtatagggagaaacttgctttaaacagtcctgacataaagtgccttttgacatcaactattcaatacctttgagactcacttagacaactggactcattgtaggttccacagaaaaacacggacaacattctagttgtcactccaaccagccacactaggagggcacagcctctggtaccctttctgttcctgaaggcatgtacagcggcttctacagcaagcttgcttacctcccaggattcacctcatggtttggacactgattcctgagagagccttgagacacacaaagtgaaaaaaatgtcaagcaggaatgaaagctctagttttttgcttgttggtatatgtaaatttgtttaaaaagtatccattctgtcgttggtagaagttttgctttggttgataatagagattctgatgtactcttataacttaggttttctcagaaattaagtagcattgaagatcaatgtaatacagttttaagcaggtacactaattatattattgattctatagaaaactaaaattatagatgaggtatcaggatccattataggttgtaaaaaaattcatgttcttcatagattgagtctaatatttcttctatagattgcatctaatgttcctactacctaaattattacgttcaaagttttgaaaattgaacgaaggtatttttaagtacttaaaacatttctctatcattctgtattacatgtataattataagatattgtttgcttcaactagctgtactttgttttcctgtgaagtttcaacttatgtgttatcgatttaacttaattgttccatctagccatgtataatggaaaaaggaagttaatatttgttattgtgttctatgccagggactgtaccaaactctgattggtacattatttcatgtctcataactctgggatctaagtattgtcacaaagagactaaaaatgagagaaaaaattacttgactaggattatgtaggtggtaataatagaatcaggatttaaactcaggacttcagatgccagcatcaatgatattctctcactggaagtggttctcaaagcaaggtcctgacaaaagcatcagcgttactggggaacttgttagaaaagcaagttcataggctgagccaccacgcccggctagactttacctttctaaagaacatgttactggattctcacgaagtacg

SEQ ID NO: 51339 - DNA, 719 bp, Homo sapiens
gaaatgaataactgttttccagactcaaggaagattcaactcgagatgtaacattaggcaggtaggcaggccagtgttgaagcactggtttactgggccggagatgggtagttcacagactccatgcatggtttgactatgaaagaggagtccatgaacacagattacatgttcattctctcaatgcagtttttggctaggttgcattaatacatattcatcaatagatcagtagaaaaacgctgagctctgttaatcatactatagatctgtagtcaaaaggtgttttttttttttaaaggtgtttttgaggagaagtaatgtgaaaaagggagcaaaccatttcataacacagattagatgccacataatatacaaagctaagagaaaggaaacttattttgggctccaaaaatgttgggatgtgagactgaaattagtactcatgtttctgatgaaaggtctcaaactgagtactgtggattattctaggccattaataaccacaaactgcttgaaataaccatggcaacaaccagtagctatgtacagtacaatcaccctgattaccatagaattagcacaaaacaaatgtttgttcttttcctaaatagatgtattatgatgatgataacagcttcctatttaccccaggttttcccatcaccactcctactccaaacaatggaaagatgacatctttgcatgatatttgtttc

SEQ ID NO: 51340 - DNA, 339 bp, Homo sapiens
tagcccacatatgcctccagcattctgtatgcctcccttccttggcagctggcacaactgcacccctgtagacagcacgtgagcctctgcagattgtgtacaagcagacacagacagctggcttgactttcctatattgagagaaagaacttaaccttagacacttctgagcactgccctaaggaaaaataaatggaagcttcgtgacacctggcctggctttgtgggattgagataaggtatagaatcctaagacttacccccaaatagggaacaagaggagtggagtgggtacattaataggaaaggtctgagaggctcccagaattcctagtcagg

SEQ ID NO: 51341 - DNA, 455 bp, Homo sapiens
ctcacagttctggaggctaaaagtccaaaattactcgacctccgaaggctctaggaagaattgctccccatctcttcctagcctctggttgctggcagtccttcacgttcatgccttagagctgcatcacttcagtttctgcctctgtcttcacatgaatgtctttgccttgtaaggatcaagtcatacaccacatacaaaaataaataccaaatggattcagataaatatgaaaaaaattatttctagaaacaaatatggaagaatatttatgaccttggagcagggatgattaaacaggataacatggctgggcgctgtggctcacgcctatagttccagcactttgggaggctgaggcaggaggactgcctgagctcagaagttcgtgggcacctctactgtggtcacaccactgcaccccagcctgggcgatggagtgagaccctgcctca

SEQ ID NO: 51342 - DNA, 425 bp, Homo sapiens
gttgaattggtgctaccgctggttgcatttggcccctttccttccatgaacctcagtggcacatggatacaagtagccccattgctcttgcacatacagaacatggcacagtctcctccctttgcatataccatctctgtctttcaggaacctgcctgtgctctcgtgtgttgcttataatttaattgccttcttttactctgcactggcttgtcctttaattgctctttattgcccttagcgttgccaatcttctgtctttgctgttacctgataacattcagatgtttttccaattcagccatccatctatcaaaatatcatgtagatggtgctttccatcgcacgatcaatggaactatccaattccaagtttccactgcagtcccctctcaacaatcaacagtatacttgacacaaaacca

SEQ ID NO: 51343 - DNA, 429 bp, Homo sapiens
ctataagattccacacactactctgtccatacctgtgccaaacaatatcatgtggtctcctctttcagacagctcctcttcctcctccacactctcagcttttggccctgcttcttatttctctgggggaatggaacaaatcagaagggaatttctgcatgctccccagcagcatggctgcccacccctctgtgtctgcacccacacggcagccttccttccagttctgtggatgacctgtttgtcctggctgcaaccacccctttccttgtgtgccagatcacattccttctcttttactcaagggcatcactctgcaattattccctctccctccttcaaccttagatgtttcctgtctattggatgattcctatcagcgttcctattgttcataccctatctatctgtagtattccctatcttgaa

SEQ ID NO: 51344 - DNA, 436 bp, Homo sapiens
catgaaagaaactatatccgcaaacgttttactaaccacagcagaccccctccttgtagaacccacaagggcagagagcatcagatgaaatcaactgctgagagaggaaagtgagtgctgtgttggcaccgctgccagaaactcttgagaatgagcatcgtgtgccacttatccactgcttgccgacttcagtagcaagagcctccagaatgctcatggataaacatcatctttgtggccacacattgttttatgagctgagtcatcagactggctggctccttaaatgctgctgtgtgattctctaggcagcagaaaacaaggagagaagatatgaagtgtatctcatcgagctttgtagagggccagtatcattcaccaaaggtgatgggggatttaccattatggagtttgcttgtgataaaaaattattgat

SEQ ID NO: 51345 - DNA, 1929 bp, Homo sapiens
taatttttgagataggatcttgctctgtcacccaggctggagtgcagtggtatgatcacagctcaccatatccttgacctccaggactcacgtgttgctcccaccttctcagcctcccaagtagctggggactcaggcgtgtgccaccacacttggcttttcttttgtttttttttcagagatgtggtttctgcaaaaccccatctcaaactggtttcaaactgccaggctcaagcaacccacccgcctcagcttctcaaagtgctgggattacaggcatgagccatcgcacccaggcaaaccctattttttatgatatgcaaaaaagtcctgtttcttactttcatatggagatggcagtttcttttccctttagatatctaacaagtaaacttcctgaaggatatttggctacagaagctcagaaagctatgagctgaatgtctggatactacttgtttcacttcatggttcaattaagaagaatagtcacaacttagaccagttatttttaatctaggaaggatgaactcttaaggaggccactaatgggcatgtaacaaagtaattcatataagaaaagtttaagtataacattctggttagggccatagctttcatcaaatactccagtctataaggctgacagttacaaaaaaacactgacttcagtcaaggaatctgatgcctaagtatacatgcaagaaaaagtactgtacatacgcacaaggataagcaggtaagaatgttcctttcggccgagcatggtggctcacgcctgtaatctcagcactttgggaggccgaggtgggcggatcacgaggtcaagagatcgagaccatcctggccaacatggtgaaatcccgtctctactaagaatacaaaaattagctgggcgtggtggcatgtgcctgtagtcccagctactcgggaggctgaggcagagaatcgcttgaacccaggaggcagaggctgcagtgagctgactgagataacgccactgcactccagcctggcacagagcgagactccgtctaaaaaaaaaaagaatgttcctttctactttctttattaatagcccaaaatgagaagcaattgaaaggcccattaccaggagaataaacagtgttacatagttcacaatggagaactacttaggaacgaagaatgaagacattataagatcatgttaacaatatagaaaaaattttaaaatttttaactaaaagaagttacaaaaatatatagagtatggtataatttatagaaagtttaagaaaatgcaaaatcatgctgtatttgtgtacaccttcaaacagtatttagtaaacatacgaaaataagcatgggaaagacaaacaccaagcggggtatgatggtgacctgagagggatgaccaggaaagtcattaggaaagcgtacatgggtctccagctgtgcccccaacacctggcttcttcaacttcagtgggcacacagggattcactgggccatcatttggccctttctggtcctcaaactcttaatctgttttcataccccagcccctaaccccacgcatgtctattttatagtgcctcactctcagatttttacagcagccccttccacttctgtgtctgctctcatattctcacttttcaacatttgaaagatcagaaaacttcctgttaaaaaatcccaattttctaccttttctaaaaagagatcagaagatctgggctagattaacaaaaagaaaatgggctatttcttgcctggtcctcataaaccactctaccccaccaaccctagacatgcatattcagtttattcagctgcctgttcaaaaatctccatttagctgtctcctaggaggcatctcatatgttaatccttattcataccacaaagatgttccttccttaggttccttttccttagtaaat

SEQ ID NO: 51346 - DNA, 479 bp, Homo sapiens
ttctggatttataaaagggagttttgctcacataattctaaaaacaaaaaaatccatttattaactcatttaaaataaaataattggcccattttgggtgatagttattcagcaaaatatttaacgtataaaattagagatgacccttcccctcttccccctttaagtatctgcttcaggtaaacatcaacttaataatgtaaaacatttcaaaaaaccatgtttgtgtgtgtgtgcataatacaggcctcctaaaagaaaagataaacagttgtggaaaagggaatttgtatgaaaataacatttgaggtctgtgaacctttgaactctttggtcttgctgctcttctgtaaaatggaagtaactcaacagtgtatttacaaagtataagatatcgaagttgtggagaagtgtattacaattcaattaattatttaggaggttttttttttttaagagtttcactcttgttgccccgt

SEQ ID NO: 51347 - DNA, 927 bp, Homo sapiens
taaagttcctccatagaaatgtgtggcatgggaacagagcctaatactttctgaataagatattaacaggcttgtagtggatgctgggaatttagaaagctctgttttttttttttttctaaagcctcccagtagaatgtcagactaataaatggactgcatatttccacagtgtttttatgacatgtttcacacactgtcttggtgcagatatgagaaagcccttgtccacagcccagttctgactcactcattaattttaccttgtattcagttttcttggggtggatctagactagaatagaatagaataagccgacctttaactacagtccttaaatgaggaaatctccaccctgggccagctgtgccaggaatcccgacgagatggaactccgctgtggtttataggcagggctgattttcaggggggagtgcacccatctggactccctgctgttcccatcaatctattccagccctggtacccctggaccaccctactgtccagcaactaaaggattaacaggagccacctccaggagcctccgggacccttcagaaggtgtctgatttgatggatcagaggctaggccactgccagctctctgcacatattttacatatcacccatttgcaggtgttgaagaccggtaagtgcccaggagctggcaggtgttgcaaacatgtcagtgtacctggtgggggcgctcctgcccagctgataggagacagcttctacccagcccacccctttggtggctacaccagcttggcacagtctctcattgctgaagagcatccccccgccaactccgcccaatccccacctccagtcttgactacttttcattggtttgtttgtttaaattgacatctcctgattttcaaaaccttgctgattaacaaagcaaaaagagcacacac

SEQ ID NO: 51348 - DNA, 416 bp, Homo sapiens
cggctctaggagcagggggtgagaccagagggcactgctgagagattagctttcaattgcatactgtatttgcaactatcttgtgataattaaagtacctaaggcttacagagtgagctgacagatggtgcagtcccatcgtaagttacagaaaacagaatcttgctccaagtacacagccggttagtagtagcaggtcagtaactatgactcttgcgtctctttccctgaaggccagtgtcacagatccgccagtccttgtagtataatgtcatgctgccctgcaattatatggtacatttctagagctcccagaatcctaaaagtcgatgctttaataagaccttttatacttgggctttaggggtaaagaggggggccccaaaagatattagtattttttatttcctgaaggt

SEQ ID NO: 51349 - DNA, 861 bp, Homo sapiens
gttaacagcttcttgctatactttccaggaagtaaatcagtggcagacagctacttacttccttatggattcaaagcccagagcattgctgaggcctctcatacctgccccttggtcgttccttcctgtcaaagccaagaggggaaggagagaagagcctcctctcaccatgctcaggaaggcattcattctcctgagagtagatgagcccatctgtattctggggccctgcctgcatctgggaaggtgtcatggtcccaacagagaatgaatcagtcccatactggtgagggctggagtagaacccccatctttgagcacttccctgacacctgaccccctcccttagttacagttgcctggttctaccaaagccactggctaccagactgtttccttcacaccccaaacttctaggtgatctgtgggatttatacctgggcagccttcaggtacgtctgaagtcccacccatgaggctcctcaaagtggagtggagtggagtgaatgaggcctgctttactccaccggaagaatatgcatttgataggggagtaaagaataaatcagactaagaaaagcaatttggtctacctagcactctcagtctatgtggccagtgaatatccacttcagtggggctgggattttcagatcaaaaaaccagaataagatgtatgggagccaggccacaagactcaggtataaaaaaagactgaggaaaactttcatgccttcctctccctctgccaggatcagtgagtgggtgtcacagaaataccctggcattaccccctggcaagcagttgataatccacagaaggtcactttgtgggttttgaggacaagacaaaaaagaaaa

SEQ ID NO: 51350 - DNA, 428 bp, Homo sapiens
tactactactaccactaaattcgcggccgcgtcccacccatgaggctcctcaaagtggagtggagtggagtgaatgaggcctgctttactccaccggaagaatatgcatttgataggggagtaaagaataaatcagactaagaaaagcaatttggtctacctagcactctcagtctatgtggccagtgaatatccacttcagtggggctgggattttcagatcaaaaaaccagaataagatgtatgggagccaggccacaagactcaggtataaaaaaagactgaggaaaactttcatgccttcctctccctctgccaggatcagtgagtgggtgtcacagaaataccctggcattaccccctggcaagcagttgataatccacagaaggtcactttgtgggttttgaggacaagacaaaaaagaaaa

SEQ ID NO: 51351 - DNA, 345 bp, Homo sapiens
caccttcctcaccctgtctccctggacagtgaattccccctgggaatgttagtgaccaaaagtcactggtttgtgtcaagtcacagtgaccaggcaaaactgggttccttaaaaagaacccaggtcaccagtcactgaaattttcttctttaaaaatagaatcaacctcaacagtagctaaatatgccccttcttgggccccagacccagggcagggtgggcagtctatgggggctctcggaaatggaatgtgcccctggccatctcagcctcctgagcctgtggtcccactcaacccctttgctgtgaggatgctctgtgcagaacagtggagcctgacttgct

SEQ ID NO: 51352 - DNA, 372 bp, Homo sapiens
caccaccatgcccagctaatttttgtatttttagtagagataggctttcatcttgttggccaggctggtcttgaactcccggcctcaagtgatcctccctcttcagcctcctaaagtgctgggattacagtcatgagccaccgcactcagcaaaagctccttccttttattgctaagtagtatttccctgtaggtctagatctcaatttgatggacatatgggttgtttccagtttttggcaattatgaatcaagctactgtttgtatttgcatacaggtcagtcagtggacatatattttcatttctctagtttgagaccagcctgggtaacgagagtgaaactctgtctcaaaaaaaaaaagaaaagaaa

SEQ ID NO: 51353 - DNA, 458 bp, Homo sapiens
aaaaaactcctctttgattcttctagctgtttcactattgggcaaccagacaccagaatgagtactaaaaagtctcctgaggaactgaagaggatttttgaaaaatatgcagccaaagaaggtgatccagaccagttgtcaaaggatgaactgaagctattgattcaggctgaattccccagtttactcaaaggtccaaacaccctagatgatctctttcaagaactggacaagaatggagatggagaagttagttttgaagaattccaagtattagtaaaaaagatatcccagtgaaggagaaaacaaaatagaaccctgagcactggaggaagagcgcctgtgctgtggtcttatcctatgtggaatcccccaaagtctctggtttaattctttgcaattataataacctggctgtgaggttcagttattattaataaagaaattattagacatac

SEQ ID NO: 51354 - DNA, 314 bp, Homo sapiens
agatttgctgagctttttacttagccattctggaagtcttgctatgcctataaaagtttatcacctcatgttctacttatgtccttttatcctacccaaagtctagagtttgggaggttttttttttttccagccagccattaaaaggagtatcaacacttgagagcaaagtaaaggatactcttaagcaaaagctaatgcctgaaatttaggtttgagccggtgcctgtagtcccagctactccggaggctgagtaggcggatggcttgaggccaggagttcaaggtggccagtgtgctatgatcgcatctgt

SEQ ID NO: 51355 - DNA, 427 bp, Homo sapiens
tatcaagcctagtttctaaagagaactagcccagtgcgtgccccacacacacactgaggagttcagttctcaagcaccggaacatcagccattttaggaggccttatttttcttcccaataaagcatactcacatcatttccttgctctaagttgggggtgggtatctaggggtgaaggttgggaggtgaaaatattatttgacagaataactatttttgcaagctgctgcactggcgggacagaggcctgggatctggcacagaggagtacccgcctcacgatctgacacccgcctccgagcagcccgccacctgcagcccggggccgggcccaggggagggggcgccagcagcccctggccctcagccatgctacctctcttcagggcactggatcagacacagcagataactggccaaaaaaaa

SEQ ID NO: 51356 - DNA, 698 bp, Homo sapiens
cttttaaaattagagttttaaatgatacaaaaagtattggagatcagcattaacatcattctatactaacaagaatgaaactgttccaataagtagctaaaagacaaacttccttctgtccatggacataaattagcaagttttttttttgtaggggggtgggggcagggtctcactctgtcgcccaggctggagtgcagtggcacaatctctgctcactgtagcctcagcctcctggacttaagttatcctcccaactcactccctcccctaccaagtagctgggactacaggtgtgcaccaccacacccagctataaattagcaattcttatattcctaactagttacttgtaagaatgaatagtgtggatttgttttcattccccagctagttctaatatcctttaaggcagactcaaatttcttctgtcctcttgaattgtgaagcatcatatttttcacattgtgcatgctcaacaaatgcttatgattaataaactgactgatacggtagtttgcaagtgggaccctagcaaacataattctttccaaatgtgctgcatacatgtaaattgcaaccatttctttgggcaagaatcataaattaagctcccccaaatattcagctgagtaatttttaatagtttttttttaattataaagctaatcattatctttgcaaaattatcaggaaat

SEQ ID NO: 51357 - DNA, 433 bp, Homo sapiens
gttcttataaatccagtatcattcagaggacctggaggaattaaagcataacctagtggcagggaatatcaaaccctagatcttaaatctctcctctctgctgtgaagctgggcttgagcctgccaatgccatctaaatttcatcagctgaaagaaagagtatttatttcaacatccaaggaacccccaaaacttaatgcgccttctcaattgtctaactaatttttaaagagacatacattttgtccataaatacctgactctgtttgctaagcatgtggtgggtaatattattggttgaaaagcaataggttttcgtttactggccagattagttttattggcttttttagttgaaaatctataaaatgcggactgaattttactgtggcatattctttgtttattacatgaactcattttcaaagatgaa

SEQ ID NO: 51358 - DNA, 329 bp, Homo sapiens
gaaatgttctagttttgaaatgtgggctaaaatcgtttttaactgcacaaccaaacaaaacacctattcatttgttcagaatctgcaggagattaattcatctctgattgcagccatttgtatcatacataataagctctcagtaaattctatctgctgttattattgctatatttctatgtctgattactcagagactttgcaagtggtctacttgttttctgaacaaatttccttcatttctaattaaatactgtgttcaatacctagatttctgttggtcttccaatgcggaaaacattttattttcccttctacttttattttgg

SEQ ID NO: 51359 - DNA, 542 bp, Homo sapiens
cagattcatctggattcagaactccaggcagaagctgcttaacagcaaaaatctggcatcttcactacattttaagattttaggtagaactaagagggatcagatatagaggaataaggaatgtgagaaggaaaaagatatagtagtttagctaaatttttcttagagtttcttggtggggctggccatgaagtaactagtctgactcatttcttctgggaaggctaaaagagacacaaatagcttctcttttaccttggctttaaggaaaagccattttattaacaaaagtattagacacgactgcataagaaatttgctgtgtgagaataaagaacaagggagtaggagggtgggacagagaagggtgagaagttggcttcgtgagggccacctgtcagttgtctttgtgccttgtgacatcaaaactgaaatgtttgtattactgttgtccatgactttttttttctgtgtcagacatacaaattgaatttggttgtaatgttttaaacgtaataaagaattcttacctaaaaaaaaaa

SEQ ID NO: 51360 - DNA, 863 bp, Homo sapiens
attctcagtatcctgtaggactataacaaaagatctaagatttctgtccctgaaaggagaaaagagggcagggtgagaaggtaatggaagaaataatgactaaaaactttccaagtttggtaaaggcacaaacatgtagcttcaagaagctgaacacattcacagcaagagataccatagtcaggtttaaaaaaaaactataggaaaatcttgaaagcagcccaagaaattatatcttacccattggggaaaacaattagaaaactagctcatttctcatcagaaatcagaggccagaaggaagtggcacattatcaagtgctgaaagataaggactgtcaactcataattctatatccagcaaaaatatccttcaggaatgtaggggaaatcaagacattctcaaatgaaggaaaatgaaggaactttttgccagtagacctatccaaaagagaagtttgtctaaataggaagaaaacagtaaaaagaaggaatctcaaagtattaggaaggataaatgtacatggtaaacagaactgtgggtatatgtaatagacttccttttgcttcatgaattttctaaattttgtttggtggttgaagtaaaaattttaactctgatgtggttctaaatatatagagaaaatattttaggtaattatattataaatgagcaaggacaaagggatataaaaggaggtgaagtttctacatatcactcaaactgacaaaatgaattcagtagaccatgataagttacataaatataataactagaacaaccactaagaaagctatacaaggagatacatttaaaacattatagataaaatggaatcctgaaatatgttcatgtaacaggc

SEQ ID NO: 51361 - DNA, 1046 bp, Homo sapiens
ccaggctggaatgcaatggcacgatctcagctcactacaacctccgcctcccgggttcaagaaattctctgcttcagcctcccaagtagctgggattacaggcacctgccacaatgcccagctaagttttgtatttttaatagagacagggtttcaccatctttgccaggctggtcttgaactcctgacttcgtgatccacctgcctcggcctcccaaaatgcgggattacaggcatgagccactgcacccggccaagtgctagcatcttagacaacacctctccaaaaataccaaaagattgagaaaaactgggttattttagtgtgggaagtgcaggtataaactatttcttcttaaacctcagaagacttgcaaatatcctagctgggactatgggggtgaagtacaaaattaagataaattattcaagatataaaaatttggcaaaaaattactttgtgtcctttaaagttattctttagcattaaaatttaaagtctaaacgatttttagagattcaaaagatatcaccaaaggctgtcctgtaggaaattaagcaatttagtatctaactttgaaatcttttatttagctttttcctttctttcttttttcactgggtatacaaatcagtctctgtattctccttggaaccagcttttgttatcttgttgatttcctcattaaagagataaagaaatctgcaacacatgacatatttgtgagttatgttcttaactttttgcaaggaatactttgacaacacatacactaatcctataacaaatgctactaacaaacactacattgcaatatttcaacattcacagatgaacattcaaaaaaattcaagaaatctctgagatgtcagaagtaaaagcagtctttctcttattaaaaaagaaatggggaaggaaagcaaattaattgagaagaagctcagaagtctggagatgtcaaggtatattttcaagcacctaacaagaaatgtggaggtttcctcaatgccaggcccgtgtcctaacctgaaatcacttaggtctg

SEQ ID NO: 51362 - DNA, 912 bp, Homo sapiens
tatggttcttagctctctctcgtatttggaagtgttcagaaacatggctgcttattttctgagatttctttcctttattccctcactccactttcaaaattaccctttcttaaagtgtactatttggtgttttttagtatattcacagagggagaaaccattaccactatcttattttagaagatatttatcacccccataagaaaccccatacttattaatagaactcctcattcctcacttcttccagcccctggcacccactcatctaccctctctgtctctagatttgcctatgttggacattggatataaatggaattatacaatatatgatcttttgtgactggcttcttttacttagcataatgttttctaagttcgtcattctgtagcatgtatcagtatagtcatttgctgcataacagagtttcagggccaggcacagtagctcatgcctataatgccagcactttgggcggctgaggtaggaggatcatttgagcccatgagtttgagatcagcctgggcaacatagtgagactacatcagaaaaaataaaatagacaggcatggtggcacgcacctgtggtcccagccactcaggaggctgaggttggaggattgcttgagtttcaagaggttgaggctgcagtgaggtgtgatcgcaccacttccagcttgggcaacagagcaagacaaccctatctcaaaaaatctaaaacgaacaaaaaaaaaaacacgacatttcagtcaacagtggattgcgtgtacgatggtggcaatttctatcacctagtaacatcatagaccttccaataggataagatgtggaggtggaagatagtgatattgatgatcctaaccctgtataggcttaggcttatgtgtgtgtttctgtccgtttttagc

SEQ ID NO: 51363 - DNA, 317 bp, Homo sapiens
attaatttggtagttcctgtatgagcccacgttcatttgactttgctgaagatttccagagtatgagaaacacttttttaggctttagtgaaagacaaaggtaaatgaaaaccattagctgtaagtcttcttaactgagggctccaggaggtcaaggaccaccatatctctctgtgtatatgcagcgcccaagccagtgcctagggagttttgcgtacttcatgaatttccttacaaatccttcatgactaatttcttctatttgatttcttttctttatacctctctctgctgagtgttaatctgttaatcttaca

SEQ ID NO: 51364 - DNA, 667 bp, Homo sapiens
tctgcacttattttttttatagctatgtagtgttccattacgtggatttactataatttagtcagttccctattggttgacaatgacactgggatgtttctgatcctttgggtgtattataaacaatgccgtaaggaattatcttgggcagctatcattttatatattagtatttctgcaggatgaattcctagaagtagaattgctctgtcaaagggtttgttactcatctgaaccttaaaaagactggtttcttgaaaactcagtctcttaaagcgaaaattaacaaaacaactttagttttaaactaaaaatgggattaggccaggaatggtggcttatccctgtaattccagcactttgggaggccaaggtgggatgattgcttgagcccaaaagtttgagaccaacctggacatagcgagacctcatctctacaaaaaaaaaaaaacaaaaaaaacaaaaaacaatcctgcagcctgagtgacagagcaacaccctgtctcaaaacaattacttaattaaaaaaaagtttttaagggcctgggccaggtgcagtggctcacgcctataattccagctttttggaaggctgtggcaagcggactgtttgagatcaggagatcgagaccagcctgagcaacaatggcaagaccccatctctaca

SEQ ID NO: 51365 - DNA, 366 bp, Homo sapiens
gagagtataataacatagggttactttcatatgtacatagggttacactctcacccaactacttgagaagaatgctacaagggggatgggagcagtagaccacagggaatctgatttatttgtctctgtaagtacaaagttatactattttactgcagtaaaggtgtaatctgagtaaaaatgtaaagaccttaagtttcatcagtaagtaagaagttccagtaatgtaagattttgcaatgggtcactttgtactgtgtgcattttttaaactatattcaaagatcctgaagcttcactgtccatgaccaattttgctcttataatatttataaataaatatccagaggtgggataaatgcatga

SEQ ID NO: 51366 - DNA, 719 bp, Homo sapiens
catgtctcaaaaaaaaaaaaaaagtttaattcagtatagatattaggtcaaaaatggattaaattattgcttaattttaaactagttccttggagctcagaatgctgtcgtaattgatagctgggtgctcgggctgacccacagatcatagccttcatagagtgaatacgtcacctatagcagcccccatcccttagccgtgatggtggagagcctctgtcactctgtgtgtgtgtgtgtgtgtgtgtgtgtgtgtgtgtgtgtgtgtgtgtgtggtcattcagctagcaactcacagaactctttaaggcaatacttctcaaactatctttggcaaaggacctgatattcaagtttctagtctgttatagactggcatttttgtgcgtcaaattgtatgcatacatttgattttttcttaattgaaatataacttaaataacataattatatttaccattttaaagtatataattgtgtggtcttgtagcatattcataagattgtgcaaccattaccaccattctctaattccagaatattttcatcacccctccctgcaaaaaaatcccatacccattagcagtcactctccattgccccttcccccagctcctggaaatcactaatttactgaatccaaggatttgcctattttagacactttatataaatagactcatacaatatgtgtggccttttatgtctgtctttcactt

SEQ ID NO: 51367 - DNA, 846 bp, Homo sapiens
gtatatctatgtgagtctgcatacttggagaatttccttctatcgatcaaaaaatattccagcacagagcaggacattctcctgaataagccttatcacttaaagcatttcctcctcaaaggcaatccatttaggtgaagtgcagagacaactgagttgaaattcatcaagaggggaatgttggcccccaaagcattatgggccattaagtctgtaatgtggcagaggcctctggatagccagagttccttccttcctggtgaattgcaagggctgctgtgccggcaccttcctgttatagtctctgtcatacacacaagcactcagacattctcctggtgtttccctcttccttgggcacctgtgtccataacggaggatggtgatagctgggagactcccgcttggatgtcagtggaggccatggggccccttccaccacaggtctcaggattaaggagctgcagttttcatcgcaacgagtgcccctttccctgcttatagcttggaggacgctagtcctgggctctgggagggatatagatagatacctgtgtccctctgccctctcccttctgctaggaccccggcctgctcagtttgccaagggtggcttgttttccgtctggagtgtcaagcctgcattgagagggaaggcgtggggctggaccttccagcattgtgtatgtaggagtgggggtggtgggcagggtgagtaggacctttgtctgactaggaccaatagttttgaaatgacttgaaaaaaatttgatcttggggaatttccagcatgagtaaaacctagagacttctcagagttttgagaaagccaccccctgtcaagcc

SEQ ID NO: 51368 - DNA, 462 bp, Homo sapiens
  misc_feature (402)..(402): n is a, c, g, or t
  misc_feature (410)..(413): n is a, c, g, or t
  misc_feature (416)..(416): n is a, c, g, or t
agagtaaaactaatttaataatcataagtactttctttcactgtgttgacatttgcactttggctcaaaagtgatgttttggaaaacttgctggttaggaaaaaatcagtgcagtttcttcaaactatgttctgcagcaccatcaccacatatttatagtaaacgaagttttacttggtcgggcatcgtggctcatccctgtaatcccagcactttgagaggctgaggcaggagaattgcttgagcacaggagtttgagaccagcctgggcaacatagggagacctcgtctctataaaaaaaccaaaaatgttagctgggcatggtgatgcgtgcctgtagtcccagctacttaggaggctgagctgtggtgatcccttgagtccgggaggttgaggctgcngtgagccnnnntcncgccattgcactccaggctgggtgatagagtaagactacatctctt

SEQ ID NO: 51369 - DNA, 445 bp, Homo sapiens
ggagcagacacttcagaatctggagcagtcatacgtggaaactatagactgggacttagcaaaaagtcaagcctgttcagccaccagaagcatcatgtgtgccctgaatgcgggagaggcttttgcagagatcagaccttatcaagcaccagaggacacacaccggggagaagccatacctgtgtcctgagtgtgggcgtcggtttatccagaaggcctccctctccatacaccagaggaagcactcgggggagaagccgtatgtgtgcagggaatgtgggcgacacttcaggtatacatcctctcttcactaatcacaagagggatttcactccgggggaggagggccctttgttattgttcagggagttgtggggcgaggcttttcgccaggaaggattaggccctcctttctacaccagaggacgcacttggaggagaagcc

SEQ ID NO: 51370 - DNA, 453 bp, Homo sapiens
aggtagaggactgtattcaagaaatgtctgctctgatttccatcatagttaaagctgtgccacaacatttcaatggtaaaggcagaagccttagccagaactaaaacaatgtagatgtgcatgctaaaaggtaataaaggcagtgctgtgctcacatgaagttcatatatcataaaacacctgtgcgggcccagctcatacctgtaatcccagcactttgggaggctgaagtggaaggatcacttgagcccaggagttcaagaccaacctgggcaacatggcgaaaccccatctctacgtaactccaggtgtgatggtgcacacgtgtagttccagctactcgggaggctgaggtggcaggatggagtgagccccaggaggttgaggctgcactgagctgtgattatgccactgcactccagcctggacaatagagcgagaccctgtctcaaa

SEQ ID NO: 51371 - DNA, 794 bp, Homo sapiens
aagagaaaatgtctaaagttgaaaaatgaagaaataggccatggtcgtggctcatgcctgtaatcccaacactttgggaggctgaggtgggaggattgcttgcccatgaattgaaggctgcagtgagccatgattgtaccactgccctcgcgcctgggcgacagagcaagactgtctcaaagaaaggaaaagaaaaaatagctgtgtaagcaagacatttagaagtcacagagtttgaaattgattgcttcttaggggcagggtgtggggagtagggcctagtgttgagcagggcctggagcttacgtattttaaactatgaactattattttgatagaaatttaaaaaattttagagttttaaatctatatcattacagactatatatattctgcgtttacactgtgaaaaaattagaagtcaatagaaaaagaaatgaaaaacctttttatatatttggaaaaattacacctctgaataattgagtcaaagaagacttgttatggaaattagaaaatatttagaactgaataatgaaattaccacatatgaaacattagggataaacgtgtttcatatgcagataaaatattagagaggatatttagttaagaagaaagactgaaaattaattagctaagcattaaactcataaaaacaaaaggtaatttggagaaagtagaagaaagttttaagagcagaaacaaatgaaataagtgaagtgaggggcagaaatattaaaaaactgatatttaaaaatagtcccaaaagatatataaacctagccagtata

SEQ ID NO: 51372 - DNA, 1097 bp, Homo sapiens
catgaccaagcccaaagtcactggggtagcatttaacagacatttgcaaaaagtttctaatgaaagatagggcaaaaagcaaaattataagtataatagaaataaaggaagttggaaaaagcaaagacaaatctaaagaaagttaaaaaaaaaaacagacaaacccaaagctaattactatccttagagaattaagagaaagcattgcgttcattaaacaaggacaggacagaatgccatcagataggaagaattacagcaggaaaacttggaaattatgatgggtataaaaaacccagtaaaagtgttaaaagatgaagttgaggaaacttctaagcagtagaaaaaacagatagaaaacagaaaaatagatttgagaaccagtccagcagaaccaacatccatctagtgaaacagaaagcagagaaaatgggaagaggatttttttattttcatttttgcgacagagcaagactgtctcaaagaaaggaaaagaaaaaatagctgtgtaagcaagacatttagaagtcacagagtttgaaattgattgcttcttaggggcagggtgtggggagtagggcctagtgttgagcagggcctggagcttacgtattttaaactatgaactattattttgatagaaatttaaaaaattttagagttttaaatctatatcattacagactatatatattctgcgtttacactgtgaaaaaattagaagtcaatagaaaaagaaatgaaaaacctttttatatatttggaaaaattacacctctgaataattgagtcaaagaagacttgttatggaaattagaaaatatttagaactgaataatgaaattaccacatatgaaacattagggataaacgtgtttcatatgcagataaaatattagagaggatatttagttaagaagaaagactgaaaattaattagctaagcattaaactcataaaaacaaaaggtaatttggagaaagtagaagaaagttttaagagcagaaacaaatgaaataagtgaagtgaggggcagaaatattaaaaaactgatatttaaaaatagtcccaaaagatatataaacctagccagtata

SEQ ID NO: 51373 - DNA, 374 bp, Homo sapiens
tgacttagaggatccccaaacacgcaacttcctgctcagcctcctgggtagctgagattacaggcacataccaccatgcccagctgatttttgtatttttagtagagttggggtttcaccatgttggccaggctggtctcgaactccagaccttaggtgatctgcccacttcggcctctcaaagtgctaggattacaggcgtgtgccactgtgcccggccagaagagaaactttcaaaaagacaggaacatttccttgaactgatagagcaggagccttcagtttgcaaaggtacaccattgagagagactagcttaaaaaatgtaaaaattgccacactgactgaaattttagaacttttgcgataaagtaaa

SEQ ID NO: 51374 - DNA, 453 bp, Homo sapiens
gaaggcaggtagcatactacctttaaaatttaggaatcagaatagtcctagacttaccattaggaacagtggaaacttagactctaatgaagctgttcattcaaaatacaaagtgaatctgattttcaacctaagattgcatgcttaacccaactttgaatttcggagtaaaaatattttcagatttgcaaggtcatagaaaatttgattctttgtaaaagatattggagtgggggatggattagctaaagcatgactttctacagtgaagagaaaatgtctaaagttgaaaaatgaagaaataggccatggtcgtggctcatgcctgtaatcccaacactttgggaggctgaggtgggaggattgcttgcccatgaattgaaggctgcagtgagccatgattgtaccactgccctcgcgcctgggcgacagagcaagactgtctcaaagaaa

SEQ ID NO: 51375 - DNA, 577 bp, Homo sapiens
ccagactggagtgtagtggtgcgatctcggctcaccacagcctccacctcgtgggttccagtgattctcctgcctcagcctcctgggtagctgagattacaggcacataccaccatgcccagctgatttttgtatttttagtagagttggggtttcaccatgttggccaggctggtctcgaactccagaccttaggtgatctgcccacttcggcctctcaaagtgctaggattacaggcgtgtgccactgtgcccggccagaagagaaactttcaaaaagacaggaacatttccttgaactgatagagcaggagccttcagtttgcaaaggtacaccattgagagagactagcttaaaaaatgtaaaaattgccacactgactgaaattttagaacttttgcgataaagtaaaactcccagaaagttcctgtctggggtagggggcaataggagggaaggcaggtagcatactacctttaaaatttaggaatcagaatagtcctagacttaccattaggaacagtggaaacttagactctaatgaagctgttcattcaaaatacaaagtgaatctga

SEQ ID NO: 51376 - DNA, 475 bp, Homo sapiens
atgcacaacaatgcaccaaaaaaaccaagggagcagctgttttttttgtcatctccaggttggggttacatctctaatggcatataacctcacacacgatttgactctgcagtgttgggagtgctgttggaaagctgagcctgagagacagattgaggaaggagatttacttggtgtttgtttctgtgtcacagctttccgtccatttaactcttgatctgttttctggaagtgctcaaaatcgcagtaggctctcaaagctggaacttgagatgcatctttggcttaaattacaagtgaaatagaatgtagtggccatttaccctggtctaaaagaacatcagtcaatctgtctcactggcaggggtgtggggactgggtcggcagaagcgctgtgtagatgctgtccccaggcctctgccatcgcacactgagggcacccagctccaccacctccttgctgccttctgaccgc

SEQ ID NO: 51377 - DNA, 569 bp, Homo sapiens
atttctagtagcagtaagcactatgaaggaaaataaagtggggaagagggatgcagaataatggggctgctgtttcacatagggtggtctctttggtaaagcagcatttgagaaagccttgagggaagggaggaagtgagctatgcagagatctgagggaaaagcagagagaacagaagaaggctagcatggctaaaccagagtgtgggaggagaggaaatgtaaaaggagaggaggtcagagggagccaggggcctttcaggcttttggaagactttgctttcctctcagtgaaatgagaagccagtggtgggctttgagaagaggagggattggatctgacatatatttatgttgtgttgaaaatagactctagggaggaaaggcaggtgccggagacaaataaggaagctactgcaatcatctaggcatgagtttgtggtggctgggaccagggagagagcagtgcaaagtggggcaaagtggcgagattcagtatctagttcaaaggtagagccagcagaactgacgtggtggatgtggtgggtaggagaaaaaggagaagtcca

SEQ ID NO: 51378 - DNA, 496 bp, Homo sapiens
ggggcaccccggccccccccagccccgctccctccgcacgactcccccccacacaagcggagaaaaggtttccctacacggaaaaggcgcggccgatggaaatctccgtgaaatctactatctatgatcctgcctgcaacccctctccccagcttggcgcagtcgaggggggcgatgctctctgcccatcccagctgcaccctagctccccttccctaacagttcctgttcttgacttgaagagaattgacccgtgggggactccccacctccccaacccagactttggagcgggtgggagttgtaagacaaatcaaaatacggatgacaaagaggatatagccgtgtataccccagggagaggaggcgccgagttctgatgggagaggtacaggttgggttctctgcctaccattgctgtctctgacttccagagctcaaccccctcctttctcccagtggtgacaagatatcaataaacttatttttaatacaa

SEQ ID NO: 51379 - DNA, 1334 bp, Homo sapiens
ggggcaccccggccccccccagccccgctccctccgcacgactcccccccacacaagcggagaaaaggtttccctacacggaaaaggcgcggccgatggaaatctccgtgaaatctactatctatgatcctgcctgcaacccctctccccagcttggcgcagtcgaggggggcgatgctctctgcccatcccagctgcaccctagctccctgctccagggatgtgagcacccactccctgtgctagttagtgcctgattctctggggggggcctcagtaatgggcccccccaacccctttctctggtacagtgctgtctgcctggctgcctcccttaaccctgacttctaagccatcaatttcatgttatttattattgccctatgtggggtggggagggaacctctcgggtctgcacatctccccttccctaacagttcctgttcttgacttgaagagaattgacccgtgggggactccccacctccccaacccagactttggagcgggtgggagttgtaagacaaatcaaaatacggatgacaaagaggatatagccgtgtataccccagggagaggaggcgccgagttctgatgggagaggtacaggttgggttctctgcctaccattgctgtctctgacttccagagctcaaccccctcctttctcccagtggtgacaagatatcaataaacttatttttaatacaaaaaaaaaaaaaaaaaaaaaaaaaaaaaaaaaaaaaaaaaaaaaaaaaaaaaaaaaaaaaaaaaaaaaaaaaaaaaaggggggggcgggcgaagaaaagaatctctcctcaacgggaggagggagcaaacagacaccaagcagcgaagcagccagcaagtatgtggagcgaaaacagagggggctccctcataatgagagcgagggatatattatataagcgacgcgacggaggcggcgccgaggcttaataaacagacccggcacggaaggggggagcaaacgacgcaggagaaagagcgggcgccaaaacctgtggagagggagagaacaccccacaaccaaatgagggcgagagagggcagaccacacaaggaggtggagaaaaaacacaaaccaccaccgagagaacgagaagaacaaacgcacgcacacgcggggggagaacaaagaaacagcaacgagagaaagaaaaggaagcgcggaacacaggaggggagaaaaaaaaaagaagcagacgagcagaacaaaaagccgccctcccgagtcgagagaacagaaaaatgagagggaaagaacgcgagggggagtagtacgaaagagataaacagaaacatatatcaac

SEQ ID NO: 51380 - DNA, 404 bp, Homo sapiens
gcggccgcctactactactactgctcgaattcaagcttctaacgatgtacggggacatgttatttattattgccctatgtggggtggggagggaacctctcgggtctgcacatctccccttccctaacagttcctgttcttgacttgaagagaattgacccgtgggggactccccacctccccaacccagactttggagcgggtgggagttgtaagacaaatcaaaatacggatgacaaagaggatatagccgtgtataccccagggagaggaggcgccgagttctgatgggagaggtacaggttgggttctctgcctaccattgctgtctctgacttccagagctcaaccccctcctttctcccagtggtgacaagatatcaataaacttatttttaatacaa

SEQ ID NO: 51381 - DNA, 711 bp, Homo sapiens
ggggcaccccggccccccccagccccgctccctccgcacgactcccccccacacaagcggagaaaaggtttccctacacggaaaaggcgcggccgatggaaatctccgtgaaatctactatctatgatcctgcctgcaacccctctccccagcttggcgcagtcgaggggggcgatgctctctgcccatcccagctgcaccctagctccctgctccagggatgtgagcacccactccctgtgctagttagtgcctgattctctggggggggcctcagtaatgggcccccccaacccctttctctggtacagtgctgtctgcctggctgcctcccttaaccctgacttctaagccatcaatttcatgttatttattattgccctatgtggggtggggagggaacctctcgggtctgcacatctccccttccctaacagttcctgttcttgacttgaagagaattgacccgtgggggactccccacctccccaacccagactttggagcgggtgggagttgtaagacaaatcaaaatacggatgacaaagaggatatagccgtgtataccccagggagaggaggcgccgagttctgatgggagaggtacaggttgggttctctgcctaccattgctgtctctgacttccagagctcaaccccctcctttctcccagtggtgacaagatatcaataaacttatttttaatacaa

SEQ ID NO: 51382 - DNA, 629 bp, Homo sapiens
  misc_feature (278)..(278): n is a, c, g, or t
  misc_feature (284)..(284): n is a, c, g, or t
ggggcaccccggccccccccagccccgctccctccgcacgactcccccccacacaagcggagaaaaggtttccctacacggaaaaggcgcggccgatggaaatctccgtgaaatctactatctatgatcctgcctgcaacccctctccccagcttggcgcagtcgaggggggcgatgctctctgcccatcccagctgcaccctagctccctgctccagggatgtgagcacccactccctgtgctagttagtgcctgattctctggggggtgacctagncatgcngcctccgatccgcgttatatggctccaggctgaccgcctgaacggctaccttaaccccaacttccaatctataactttcttcctatctactagtgccctaagcgggcctccccggccacctcaaccacttgtgcacaaagccctccctaagacacccctgtcgttacatcgaactgaatggctccaggcattactaccctacttatccactgctacatgccttggtccacccgcacggctcctggcccctttcgcgctcgcaccccacccccggctacctccccaagacggcgccatcttcctggcaccactctcccctcaccgttctcaaccctctacctgcct

SEQ ID NO: 51383 - DNA, 852 bp, Homo sapiens
gccttctggtagaccaggccctgccacaaaaagtgccattcagaaagctcgccagcgagaagagagctccacgctcagcctcagaagaaagacgttcaacgacttactggggagagaaagaaaaggaacgggagctgagagaaagtttcacacatatgatttagaccttacgatcagccattgtttacatcgggaagcatcaatccggagtaactggcaagcagggacagggtctcaccatgtcgcccaggcttgtcttgaactcctggcttaagtgatcctccagcctcagcctctcaaagtactgggattacaggcatgagccaccatgcctggcccagcctcttccctgagaactagcagatagcacagcactcctgtttgaagcagaccaacaccttgagatttgtttaagccaagaaggaggtcctacctttaaacaagaaaaggtttatgactctcttgacatactccagggattcctgtctggcagtgctcaggaagaacaactgaaaaaaacagacctctaacatttcagaactgtcagagacaaaaactgacagagacaaagaacacccaatccagccttctcatgttgcaaaggaagacgttgaggctagagacaaggagcgcctcactccaggtgcggttatggcagaactcaaggggcaaaactgggtggcaggagaattgcagagaggggtagagggctctctctcgccttccgactgggactgtattactttcattatttcagtgcctgtgagcatgagaatgcgccaatgctatagataattaaggcaaaagttgtgggaggtggagtatggtatcacagctaccagtaataccata

SEQ ID NO: 51384 - DNA, 1191 bp, Homo sapiens
gtgtgcctgcgcgcaagccggggagcggcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagccaagccggagcctgccagagccaaggccaagctctccaagttcagcatccccaagcagggggaggtgagtctttatcagcaccgttcacatgcaactgcatagttacaagtgacaatttgaccctcgtgaattcagtttccatgtttcttttttttcagtgatgtggttaacttcatgtggtaggatttgtagcagtcactgaaaggggaggcagacttaaatagtgatttcttaaaatctcaaatttattataatttgaatttttagagttccagcaaatgcagttgtgtgtgtatgtattagttagggaaggaatgtcccctt

SEQ ID NO: 51385 - DNA, 1384 bp, Homo sapiens
gccttctggtagaccaggccctgccacaaaaagtgccattcagaaagctcgccagcgagaagagagctccacgctcagcctcagaagaaagacgttcaacgacttactggggagagaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagccaagccggagcctgccagagccaaggccaagctctccaagttcagcatccccaagcagggggaggtgagtctttatcagcaccgttcacatgcaactgcatagttacaagtgacaatttgaccctcgtgaattcagtttccatgtttcttttttttcagtgatgtggttaacttcatgtggtaggatttgtagcagtcactgaaaggggaggcagacttaaatagtgatttcttaaaatctcaaatttattataatttgaatttttagagttccagcaaatgcagttgtgtgtgtatgtattagttagggaaggaatgtcccctt

SEQ ID NO: 51386 - DNA, 1049 bp, Homo sapiens
gccttctggtagaccaggccctgccacaaaaagtgccattcagaaagctcgccagcgagaagagagctccacgctcagcctcagaagaaagacgttcaacgacttactggggagagaaagaaaaggaacgggagctgagagggacagggtctcaccatgtcgcccaggcttgtcttgaactcctggcttaagtgatcctccagcctcagcctctcaaagtactgggattacaggcatgagccaccatgcctggcccagcctcttccctgagaactagcagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggtaagtccccgtgccggccgcttcgggcgggcgggagcggcgaggggcggccgcggcggcccgcgcgtcctcacctgggccgggggctccgggcggccggccgccgtgggggtggggtgggtcgggggcgcctgcctcgccagcccttttctgcctccccgggtgggatgcgtggccgcctgcccgtctgtttccccctctcctgttcccctccctcgcggcggcccgccccagcccagggactggtgatctaggtagccaggggcagagcgcagccgtggggaggaaaagaagcgatttgaagactgtgtcactaatgcctggggatccacccgtcggccccctgctcctctcacttcctttccctccgactgcgccccctccctcctccggctggcaccaccgaccccctggagttggtgctgctgcgaagtgcccttagaggatgctccagcctccccgcctgcgcccggtctcggctgcatcctttctgtctctcccacccacttccaccgagatggaaaagtgaacatccagggcaggaaacgagtgtttctccgtgccggtattcc

SEQ ID NO: 51387 - DNA, 1080 bp, Homo sapiens
gccttctggtagaccaggccctgccacaaaaagtgccattcagaaagctcgccagcgagaagagagctccacgctcagcctcagaagaaagacgttcaacgacttactggggagagaaagaaaaggaacgggagctgagagggacagggtctcaccatgtcgcccaggcttgtcttgaactcctggcttaagtgatcctccagcctcagcctctcaaagtactgggattacaggcatgagccaccatgcctggcccagcctcttccctgagaactagcagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggtaagtccccgtgccggccgcttcgggcgggcgggagcggcgaggggcggccgcggcggcccgcgcgtcctcacctgggccgggggctccgggcggccggccgccgtgggggtggggtgggtcgggggcgcctgcctcgccagcccttttctgcctccccgggtgggatgcgtggccgcctgcccgtctgtttccccctctcctgttcccctccctcgcggcggcccgccccagcccagggactggtgatctaggtagccaggggcagagcgcagccgtggggaggaaaagaagcgatttgaagactgtgtcactaatgcctggggatccacccgtcggccccctgctcctctcacttcctttccctccgactgcgccccctccctcctccggctggcaccaccgaccccctggaaaggtttttggggttggcctgggtctgggcggaaaaaggttgcccccccttttagggagggatgctccagcctccccgcctgcgcccggtctcggctgcatcctttctgtctctcccacccacttccaccgagatggaaaagtgaacatccagggcaggaaacgagtgtttctccgtgccggtattcc

SEQ ID NO: 51388 - DNA, 1598 bp, Homo sapiens
gccttctggtagaccaggccctgccacaaaaagtgccattcagaaagctcgccagcgagaagagagctccacgctcagcctcagaagaaagacgttcaacgacttactggggagagaaagaaaaggaacgggagctgagagggacagggtctcaccatgtcgcccaggcttgtcttgaactcctggcttaagtgatcctccagcctcagcctctcaaagtactgggattacaggcatgagccaccatgcctggcccagcctcttccctgagaactagcagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagccaagccggagcctgccagagccaaggccaagctctccaagttcagcatccccaagcagggggaggtgagtctttatcagcaccgttcacatgcaactgcatagttacaagtgacaatttgaccctcgtgaattcagtttccatgtttcttttttttcagtgatgtggttaacttcatgtggtaggatttgtagcagtcactgaaaggggaggcagacttaaatagtgatttcttaaaatctcaaatttattataatttgaatttttagagttccagcaaatgcagttgtgtgtgtatgtattagttagggaaggaatgtcccctt

SEQ ID NO: 51389 - DNA, 3377 bp, Homo sapiens
gcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaatt

SEQ ID NO: 51390 - DNA, 5037 bp, Homo sapiens
ccttaacttctgagctcacctattgtctttgggaagaagcagaaggaataatcccataactaccctctgggcttcatttttcattctcctccctcaaagtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattactatttgttctatagaggagatacattctgtttctcttttgaaattgcatgcattttcaaccaaatatgaaaaagtttaagtggatagataagactgaagaataaaagggtctataaaataaaagagacaaaacgttaaagaaagaaatgaatgaatgaaccaaaaattctagggaaaatcaatttatctttccaatttagacatcttgagacagcctagcctagtgctaccctatacaattttctgtgataatgacagtgttctatgatgtccagtcccatagccagtggctaaaagtggccattgagcacttgaaatttggcctttgcaactgaaaaaactaaatttttgattttattaaatttaattttgataaccatcctgttagataatgcagatctgtcccattctcacaagtatgtgtttaaagaactcaatttgccttttcttaaagatctatataaataattaccccattatatatatgtagtagccctttcttaatgtaattttaacctgtttatttctaatcttctctccctaaagaggaaagtccgtactgcagctttgaagaaggtgagtactaatcatcatccttcatctctttctgtctcttgtaacacctttcatattgtttctgttgtttttctgagtgcctttactatatcagttactttttttttcttgttggactgtgtacctcatattaaaaaagcaaaagtgtgtgtaaatattttttttctaaaaaaaaaaatttaatcaaatttgaaccaccaccatagtcagggttttgtatgtgtgtatgcatgtccatttcctaatggaaaaaacaaaacttaggaagtgcatcattatattaggattactcgcatcctcttaaaattttgctggggagagtttgtctccaaagtatacattaacacagttccgttactatttacacttgccacttgaacaaatagacacatctcataaaatttggttggttaaagtttatattaaattgttcattaatttaatgtcaggaaaaaaagaatgaaactgtatgctgtgtcttaggaaattatcaggtcagtgtccatttgggtctatttacttatatattataaggactagttacttaagaataaaaagagattctgtcatgagttagcactgtca

SEQ ID NO: 51391 - DNA, 5109 bp, Homo sapiens
gcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattactatttgttctatagaggagatacattctgtttctcttttgaaattgcatgcattttcaaccaaatatgaaaaagtttaagtggatagataagactgaagaataaaagggtctataaaataaaagagacaaaacgttaaagaaagaaatgaatgaatgaaccaaaaattctagggaaaatcaatttatctttccaatttagacatcttgagacagcctagcctagtgctaccctatacaattttctgtgataatgacagtgttctatgatgtccagtcccatagccagtggctaaaagtggccattgagcacttgaaatttggcctttgcaactgaaaaaactaaatttttgattttattaaatttaattttgataaccatcctgttagataatgcagatctgtcccattctcacaagtatgtgtttaaagaactcaatttgccttttcttaaagatctatataaataattaccccattatatatatgtagtagccctttcttaatgtaattttaacctgtttatttctaatcttctctccctaaagaggaaagtccgtactgcagctttgaagaaggtgagtactaatcatcatccttcatctctttctgtctcttgtaacacctttcatattgtttctgttgtttttctgagtgcctttactatatcagttactttttttttcttgttggactgtgtacctcatattaaaaaagcaaaagtgtgtgtaaatattttttttctaaaaaaaaaaatttaatcaaatttgaaccaccaccatagtcagggttttgtatgtgtgtatgcatgtccatttcctaatggaaaaaacaaaacttaggaagtgcatcattatattaggattactcgcatcctcttaaaattttgctggggagagtttgtctccaaagtatacattaacacagttccgttactatttacacttgccacttgaacaaatagacacatctcataaaatttggttggttaaagtttatattaaattgttcattaatttaatgtcaggaaaaaaagaatgaaactgtatgctgtgtcttaggaaattatcaggtcagtgtccatttgggtctatttacttatatattataaggactagttacttaagaataaaaagagattctgtcatgagttagcactgtca

SEQ ID NO: 51392 - DNA, 3683 bp, Homo sapiens
tcccgtcggcagtatgtcgatctgggattcgtacaaggtcgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattactatttgttctatagaggagatacattctgtttctcttttgaaattgcatgcattttcaaccaaatatgaaaaagtttaagtggatagataagactgaagaataaaagggtctataaaataaaagagacaaaacgttaaagaaagaaatgaatgaatgaaccaaaaattctagggaaaatcaatttatctttccaatttagacatcttgagacagcctagcctagtgctaccctatacaattttctgtgataatgacagtgttctatgatgtccagtcccatagccagtggctaaaagtggccattgagcacttgaaatttggcctttgcaactgaaaaaactaaatttttgattttattaaatttaattttgataaccatcctgttagataatgcagatctgtcccattctcacaagtatgtgtttaaagaactcaatttgccttttcttaaagatctatataaataattaccccattatatatatgtagtagccctttcttaatgtaattttaacctgtttatttctaatcttctctccctaaagaggaaagtccgtactgcagctttgaagaaggtgagtactaatcatcatccttcatctctttctgtctcttgtaacacctttcatattgtttctgttgtttttctgagtgcctttactatatcagttactttttttttcttgttggactgtgtacctcatattaaaaaagcaaaagtgtgtgtaaatattttttttctaaaaaaaaaaatttaatcaaatttgaaccaccaccatagtcagggttttgtatgtgtgtatgcatgtccatttcctaatggaaaaaacaaaacttaggaagtgcatcattatattaggattactcgcatcctcttaaaattttgctggggagagtttgtctccaaagtatacattaacacagttccgttactatttacacttgccacttgaacaaatagacacatctcataaaatttggttggttaaagtttatattaaattgttcattaatttaatgtcaggaaaaaaagaatgaaactgtatgctgtgtcttaggaaattatcaggtcagtgtccatttgggtctatttacttatatattataaggactagttacttaagaataaaaagagattctgtcatgagttagcactgtca

SEQ ID NO: 51393 - DNA, 422 bp, Homo sapiens
ttattttctacttattgttttaaactttaaatcatatttggaatggcttcccttttcttgacataatgtttcacaaaagcagttcggtttaatcaagttgaaaaagtggtacgttttttaaatttaggagctataagaaattggccaggcacagtggctcactcctgtaatcccagcactttgggagttggagatgggtagattgcttgagctcaggagtttgagaccagcctgagcaacatggtgaaaccccatctctacaaaaaatacaaaaatttagccaggtgtgttagtgtgcacctgtagttccagctactcaggaagctacagtgggagaatctcttgaacctggatgtcaaggctgcagtgagctatgttcacgccactgcactccaacctgggtgacaaagcaagactgtctc

SEQ ID NO: 51394 - DNA, 372 bp, Homo sapiens
gagaaaaagttacaaatggtatatggttcattaatgttttcttctattttttttaataacttcagaagtattgcccaattaatagagaaagaagaacagagaaaagaagtacagaatcagctagtagacagagaacataagctagcaagtaagtggcttcttatttaatacattttctatttttaatgtatttattttggaagcatgagtggttttgtttgcttttttattttctacttattgttttaaactttaaatcatatttggaatggcttcccttttcttgacataatgtttcacaaaagcagttcggtttaatcaagttgaaaaagtggtacgttttttaaatttaggagctataagaaattggcc

SEQ ID NO: 51395 - DNA, 480 bp, Homo sapiens
atttgttttcagtagatacttttagtttagaataatttttaaatcacaaagtctgtttaaaaaagtcttatttgtaaaaccttactgtctaatttgagaaaaaagccatagccctcaaaactggttagaagtataaattttaaataaaaatttaaatattcacaggagacttaggtcaatggcatattgaaggaaatataaaaaatttaaagagagtgttacaattcagtgatgactttttctgtattgtatattccatctttgcttttaatcatttgtgatggataattctccaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaaatatcctttactgtcattaacgtg

SEQ ID NO: 51396 - DNA, 239 bp, Homo sapiens
agcttattagatacttagtaaacttttaaattgtaggtatgtgttgagcatatgatatagatgatagtggtaaagtctatcttctttttttttttgaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagag

SEQ ID NO: 51397 - DNA, 3995 bp, Homo sapiens
  misc_feature (3984)..(3984): n is a, c, g, or t
ccttaacttctgagctcacctattgtctttgggaagaagcagaaggaataatcccataactaccctctgggcttcatttttcattctcctccctcaaagtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattactatttgttctatagaggagatacattctgtttctcttttgaaattgcatgcattttcaaccaaatatgaaaaagtttaagtggataggccggatatattggggatccnctagaggcgac

SEQ ID NO: 51398 - DNA, 5026 bp, Homo sapiens
gcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattactatttgttctatagaggagatacattctgtttctcttttgaaattgcatgcattttcaaccaaatatgaaaaagtttaagtggatagataagactgaagaataaaagggtctataaaataaaagagacaaaacgttaaagaaagaaatgaatgaatgaaccaaaaattctagggaaaatcaatttatctttccaatttagacatcttgagacagcctagcctagtgctaccctatacaattttctgtgataatgacagtgttctatgatgtccagtcccatagccagtggctaaaagtggccattgagcacttgaaatttggcctttgcaactgaaaaaactaaatttttgattttattaaatttaattttgataaccatcctgttagataatgcagatctgtcccattctcacaagtatgtgtttaaagaactcaatttgccttttcttaaagatctatataaataattaccccattatatatatgtagtagccctttcttaatgtaattttaacctgtttatttctaatcttctctccctaaagaggaaagtccgtactgcagctttgaagaaggtgagtactaatcatcatccttcatctctttctgtctcttgtaacacctttcatattgtttctgttgtttttctgagtgcctttactatatcagttactttttttttcttgttggactgtgtacctcatattaaaaaagcaaaagtgtgtgtaaatattttttttctaaaaaaaaaaatttaatcaaatttgaaccaccaccatagtcagggttttgtatgtgtgtatgcatgtccatttcctaatggaaaaaacaaaacttaggaagtgcatcattatattaggattactcgcatcctcttaaaattttgctggggagagtttgtctccaaagtatacattaacacagttccgttactatttacacttgccacttgaacaaatagacacatctcataaaatttggttggttaaagtttatattaaattgttcattaatttaatgtcaggaaaaaaagaatgaaactgtatgctgtgtcttaggaaattatcaggtcagtgtccatttgggtctatttacttatatattataaggactagttacttaagaataaaaagagattctgtcatgagttagcactgtca

SEQ ID NO: 51399 - DNA, 1003 bp, Homo sapiens
gcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccaggtatgactcacttcagtcaattttagaacttttttatttttaaaccaagatgtgttggttataaacagaattgtcttcttaaaatataataaacttggattctactgattcacagta

SEQ ID NO: 51400 - DNA, 1643 bp, Homo sapiens
agtgcagcgcggggcggggcgggccggtgcgcctggcagtcggctgcgtcctcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttgg

SEQ ID NO: 51401 - DNA, 896 bp, Homo sapiens
agtgcagcgcggggcggggcgggccggtgcgcctggcagtcggctgcgtcctcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaagtaacagcttcaagcatg

SEQ ID NO: 51402 - DNA, 1033 bp, Homo sapiens
ctggcatttctgtgcctcctgggactgaaatctctgtttctccacctggaagatgaggcctcctgctcccaggggcagacagatgttaagaacttcccggcgctagtgcccaccagactgcgctcctcctaatgcggggacatgaggctgacaccaatgctccctgggaagctcgggctcccagaccacagtaaacactgcgttaaaacagcaacaaaaatgttacaatagtaagagctacaacagtaacatcaacaaccacgtcctaccccacgagtggctcattctagcaaaattgacaatgaagggcttgaaagcgatcgcatttaggaggccagagcccagacgacgaccagctccgaaccccacaagccttgtcgtgaccgcgccccgcaggcggggggccccctcgcgggtcacccgcaggggcgcacctccaatttaccaaacaaggtcgcatgccccagccgggctctagtccccgcccagtctggggcgcacctgtgcagggcgcgtgggcaagcgagggcgggcggctgcgcgccgctccgtgtgcacgttcctgttccggactttctgggcgtcccgttacgaagcctttcctcggcccttcctcaggtgcgcagcgcctccgggagccggtcccggcggcaccgggcacgacgccatcttccctcttttaagggcaccggggctgtgcggccgcggccgtgggctggcgttgccgcgctacggtctggccgggtccgcacgaccccagagttcggagccgggtgcccggaagccgcactggaggactgtgcggcggcgatggggcgtccagccgtcgcggcgagacgcagagggaccaccccattgcacaggcgcggagactgaggcccgcaggggccgcgcctggcacgatcgcccgtcggggacctggagccccggacagagagggtacgtttcggagccggagtcccgagacgtcgccccgccagcgacttgctggagcggtaaaacctgggcacggctccccacacttccagccgct

SEQ ID NO: 51403 - DNA, 613 bp, Homo sapiens
accgtggagtgacgtaagtgtttatctggactgggcgtggtggctcatgcctgtaatcccagcactttgggaggccaaggcgggtgcatcacctgaggtcaggagttggagaccagcctagccaacttggtgaaaccccatcactaaaaaaatacaaaaattaaccgggtgtggtggcactcgcctgtagttgcagctacttaggaggctcaggcaggagaatcacttgaacccgggaggcagagattgcagtgagccgagatcataccactgcacttcagcctggttgagcagagtgagaacctgtctcaaaaaaacaaaaacaaacaaaaaatggttaaagagtgtcttcttaatgtgtttgatgtacatttcatctgtgtgttaacttttagggaagaaggaggggccggcgtcagtgacgtcagcgagaccgaggtgagcgtgggcgttgccagtggtgctctgtcagtgcctatggtaggtacagcctgagacggccccttagggaccatttgcccacacggtgggagagagggcgcggggcctgggagggacacctgatggtctggctaaagcacctgccccagttgcttagtgaaatgtggatgag

SEQ ID NO: 51404 - DNA, 1791 bp, Homo sapiens
agtgcagcgcggggcggggcgggccggtgcgcctggcagtcggctgcgtcctcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaagtaacagcttcaagcatg

SEQ ID NO: 51405 - DNA, 2650 bp, Homo sapiens
ctggcatttctgtgcctcctgggactgaaatctctgtttctccacctggaagatgaggcctcctgctcccaggggcagacagatgttaagaacttcccggcgctagtgcccaccagactgcgctcctcctaatgcggggacatgaggctgacaccaatgctccctgggaagctcgggctcccagaccacagtaaacactgcgttaaaacagcaacaaaaatgttacaatagtaagagctacaacagtaacatcaacaaccacgtcctaccccacgagtggctcattctagcaaaattgacaatgaagggcttgaaagcgatcgcatttaggaggccagagcccagacgacgaccagctccgaaccccacaagccttgtcgtgaccgcgccccgcaggcggggggccccctcgcgggtcacccgcaggggcgcacctccaatttaccaaacaaggtcgcatgccccagccgggctctagtccccgcccagtctggggcgcacctgtgcagggcgcgtgggcaagcgagggcgggcggctgcgcgccgctccgtgtgcacgttcctgttccggactttctgggcgtcccgttacgaagcctttcctcggcccttcctcaggtgcgcagcgcctccgggagccggtcccggcggcaccgggcacgacgccatcttccctcttttaagggcaccggggctgtgcggccgcggccgtgggctggcgttgccgcgctacggtctggccgggtccgcacgaccccagagttcggagccgggtgcccggaagccgcactggaggactgtgcggcggcgatggggcgtccagccgtcgcggcgagacgcagagggaccaccccattgcacaggcgcggagactgaggcccgcaggggccgcgcctggcacgatcgcccgtcggggacctggagccccggacagagaggggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggctccttgaccttcctgaatttcggtacagatcctgtttaaatgagtttcctgacttcagagtctgaaaagggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaagtaacagcttcaagcatg

SEQ ID NO: 51406 - DNA, 1704 bp, Homo sapiens
agtgcagcgcggggcggggcgggccggtgcgcctggcagtcggctgcgtcctcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaagtaacagcttcaagcatg

SEQ ID NO: 51407 - DNA, 1279 bp, Homo sapiens
ctggcatttctgtgcctcctgggactgaaatctctgtttctccacctggaagatgaggcctcctgctcccaggggcagacagatgttaagaacttcccggcgctagtgcccaccagactgcgctcctcctaatgcggggacatgaggctgacaccaatgctccctgggaagctcgggctcccagaccacagtaaacactgcgttaaaacagcaacaaaaatgttacaatagtaagagctacaacagtaacatcaacaaccacgtcctaccccacgagtggctcattctagcaaaattgacaatgaagggcttgaaagcgatcgcatttaggaggccagagcccagacgacgaccagctccgaaccccacaagccttgtcgtgaccgcgccccgcaggcggggggccccctcgcgggtcacccgcaggggcgcacctccaatttaccaaacaaggtcgcatgccccagccgggctctagtccccgcccagtctggggcgcacctgtgcagggcgcgtgggcaagcgagggcgggcggctgcgcgccgctccgtgtgcacgttcctgttccggactttctgggcgtcccgttacgaagcctttcctcggcccttcctcaggtgcgcagcgcctccgggagccggtcccggcggcaccgggcacgacgccatcttccctcttttaagggcaccggggctgtgcggccgcggccgtgggctggcgttgccgcgctacggtctggccgggtccgcacgaccccagagttcggagccgggtgcccggaagccgcactggaggactgtgcggcggcgatggggcgtccagccgtcgcggcgagacgcagagggaccaccccattgcacaggcgcggagactgaggcccgcaggggccgcgcctggcacgatcgcccgtcggggacctggagccccggacagagaggggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactgactctttgaccacattgaccagtggaatacagtaaaaatcatacatgcctgggcccaggccaattcctctgttggaaacatgtgggtgccctgagctgtcctgtgagaaggtgccatcctgaagccctcgtgccacag

SEQ ID NO: 51408 - DNA, 1747 bp, Homo sapiens
agtgcagcgcggggcggggcgggccggtgcgcctggcagtcggctgcgtcctcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggctccttgaccttcctgaatttcggtacagatcctgtttaaatgagtttcctgacttcagagtctgaaaagggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctgggtttgtgcgtcttccaccggctcatgttttcaactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttgg

SEQ ID NO: 51409 - DNA, 2578 bp, Homo sapiens
ctggcatttctgtgcctcctgggactgaaatctctgtttctccacctggaagatgaggcctcctgctcccaggggcagacagatgttaagaacttcccggcgctagtgcccaccagactgcgctcctcctaatgcggggacatgaggctgacaccaatgctccctgggaagctcgggctcccagaccacagtaaacactgcgttaaaacagcaacaaaaatgttacaatagtaagagctacaacagtaacatcaacaaccacgtcctaccccacgagtggctcattctagcaaaattgacaatgaagggcttgaaagcgatcgcatttaggaggccagagcccagacgacgaccagctccgaaccccacaagccttgtcgtgaccgcgccccgcaggcggggggccccctcgcgggtcacccgcaggggcgcacctccaatttaccaaacaaggtcgcatgccccagccgggctctagtccccgcccagtctggggcgcacctgtgcagggcgcgtgggcaagcgagggcgggcggctgcgcgccgctccgtgtgcacgttcctgttccggactttctgggcgtcccgttacgaagcctttcctcggcccttcctcaggtgcgcagcgcctccgggagccggtcccggcggcaccgggcacgacgccatcttccctcttttaagggcaccggggctgtgcggccgcggccgtgggctggcgttgccgcgctacggtctggccgggtccgcacgaccccagagttcggagccgggtgcccggaagccgcactggaggactgtgcggcggcgatggggcgtccagccgtcgcggcgagacgcagagggaccaccccattgcacaggcgcggagactgaggcccgcaggggccgcgcctggcacgatcgcccgtcggggacctggagccccggacagagaggggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaagtaacagcttcaagcatg

SEQ ID NO: 51410 - DNA, 1863 bp, Homo sapiens
agtgcagcgcggggcggggcgggccggtgcgcctggcagtcggctgcgtcctcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggctccttgaccttcctgaatttcggtacagatcctgtttaaatgagtttcctgacttcagagtctgaaaagggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaatgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaagtaacagcttcaagcatg

SEQ ID NO: 51411 - DNA, 438 bp, Homo sapiens
aagggatatatgataggaggcatttaactaatagacataagatggttctggatcatttcttccccagataagagggattatttctatagatgaataaaaatggtttctggaaagctatgcttctgtatttatatcttaattcaaaggtgtccaatcttttggctttcgtgggccacattggaagaaaaagaattgtcttgggccacacataaaatatactaacagtagctgatatgctaaaaaaaaaaaatctcataatgttttaagaaagtttacgaatttgtgttgggccacattcaaaaccatcctgggctgcatgtggcctgcaggccacaggttggacaagcttggcttagattattattttattgagagaatcatttgtattatttctggtgcatgtgatctatccacagtattctcattttctactgcctt

SEQ ID NO: 51412 - DNA, 551 bp, Homo sapiens
taaagaaatggggtctcactaagttgctcaggctggtcttgaactcctcagccccctaaagtgctgggattataccatgcctgattcatattttggcttttaaaaagcattctccactaaaaagaactatgctgcctagagaaaaagctcaagggctagtgagggtacaaaataagccagccaggaatatcttctcagggcagaaagttacgtagttctcaaagaatgacagagacatcaaaaagacacaaaagtcagcctgaagaaacttcccttgaccagatatgatacaattttgagcatcaaaactaaaatggtattaacagattatataacccatcaaataagacaaatccactaaattttttttggagtggggagggggcagttgaaagacagagtctcactctgtctcccaggccagagtgagacactctcaaaaaaacaaaaacaacaaaagaggctggggtgggaagatcacttgagcccaggaggtagtgactgtgccactgcattccagcctgggcaacagagcaagactctatctcaaa

SEQ ID NO: 51413 - DNA, 752 bp, Homo sapiens
gatcatggagggctaaataagatgggtggagctgagattacagctgacggaatggggattagacccaagtaccagataaatctagaaactagagaagtgaatgaaggaagttacagtacagaaaacagttccacgtgatcttcacacataaaggtggaagaagaaataggatgatctcatgttgtttttcaggctacggaaaaacctgcgagccctggtggttgtccatgctacatggtatgtgaaagcatttctggcactgcttcggcccttcatcaggtactagttctaggaacaaggactcctttctccttccccccattttcaaaatcaagattaagatctttctccaccttgattctttctagccttaaccactctacttctacatttttctttgcaaggatttttgggaacccttctcccaatacaaaacacagttgatttattctctcttttcagttccaaattcacacgaaaaatccgttttctggacagcctgggggagctggcccaactcatatccctggatcaagtccacatccctgaagctgtcagacagtgagtttcacacttaagaataaagccttggggtgggatgtgtaaagccaatctctacttttttaatgccttgggggacatacaaaagaacgaaaagctagagggccctgttttcgggtgctttaatgtatatggggaaactgcacacacccagagaagaaatgaaggacactactgcatccaacaagaat

SEQ ID NO: 51414 - DNA, 613 bp, Homo sapiens
ggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagtgagtttcacacttaagaataaagccttggggtgggatgtgtaaagccaatctctacttttttaatgccttgggggacatacaaaagaacgaaaagctagagggccctgttttcgggtgctttaatgtatatggggaaactgcacacacccagagaagaaatgaaggacactactgcatccaacaagaat

SEQ ID NO: 51415 - DNA, 591 bp, Homo sapiens
cttgtttactagactgatcccacagaaatcccagtaggagtcacaagatgctgggatcacaacatgtgaaaattctggctatgcctatgaaagaaagactctgatagatacaaatgaaacacgtctttggggcatcctttgtttttgaaaatctgaatttacacagcccaaaaggtatattttcttgtaccatatccttatttattttcctttgtatggaattatactgagtactactgcttttttattttgtagccttggcattgtattgattagtgtcatgtaaatttggttagtctttgattttatagtgttgacagaccttaaaaaaaaatcatggccaggcatggtggctcacacctgtaatcccaacactttgggaggctgaggtggttgaatcacctgaggtgaggagttcgagaccagcctggccaacgtggtgaaaccccatctctactaaaaatagaaaataagccacaccatgatattggagggccagatgatgaaaggccagtagatgcttgagaccggagaaaatgagaaactatgtattttttaaaaataaaatattcttaagtatatgaaacttta

SEQ ID NO: 51416 - DNA, 1064 bp, Homo sapiens
ttggctgtgttgtattccattgaacaaatgacttctatttatgcagcctgtcccctaatgatgagcattgaggttgtttacaccttttggtgagtctgtttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccacttccaaatgaggggccgtacagaccaaagtcacccctctgaggcagcgtgtggtgatgctgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgg

SEQ ID NO: 51417 - DNA, 500 bp, Homo sapiens
ttggctgtgttgtattccattgaacaaatgacttctatttatgcagcctgtcccctaatgatgagcattgaggttgtttacaccttttggtgagtctgtttgcatcctacttggacatggtttttgtacaccttttcatcactccagtggaggagactcacctgcccaggacactctgcttcccctcttgtagctgaacttaactccactgaggttttctggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggtcctgtgcttccgacttcatttcgagtgatggcagttcccaggaaggaatccacagctgacggtggctatagagg

SEQ ID NO: 51418 - DNA, 534 bp, Homo sapiens
agttttaatggaacacagccatccatgcttatgtaagtgtgcatattctctggctgttttcactgcaatagcagagttgagtagttgtgacaaagagtttatggcccacaaaacctaaaatatttactttctgatgctttacagaaaaagtttcctgaaccttattctagctatatgttgttcataaatgaatctttcgtggttctgaaggcatttaagaatctcttaggttataaattggctgggcgcagtggctcacgcctgtaatcccagcactttgggaggccgaggctggtggatcacgagggcaggagttcaagatcagcctagccaagatggtgaaaccctgtctccattaaaaaaaaaaaaaaaaaaaaaaatagctggggttggtggtgggcagtaatcccagctactcgggaggctgaggcagagaattgcttaaacccaggaggcggaggatgcagtgagccaagatcgcgccactgcactccagcctgggcaacagagtgaaacaccatctcaaaaaaaaaa

SEQ ID NO: 51419 - DNA, 390 bp, Homo sapiens
aagacacttgtcacttgattttgaggctacctggataatccaggatgatcttatctcaagattcttaacttaattacatctgcaaaacccctttttccaaataacatttgcagattctggggattaggacatgaacatatcttttgtggggttaccatgcaacacactaaaatatggttctggaaatttttgctaaggacatcagtaaggtatgctaaattatgcaaaaatctaaaggatatttaacgtttgtgcataattttaaaaatgggccaggtgcagtggctcacgcctgtaatcccagcactttggaaggctgacgtgggcggatcacttgagtccaggagttcgaaatcagcctggccaacatggcaaaacctcgccgcttgt

SEQ ID NO: 51420 - DNA, 308 bp, Homo sapiens
actgttgtgcaagccaaaccagtcagtgttgaagccttctttggtcttccaagatccacaattgaggactgcacactctgattgcatttgtgggaccacgatgctccttgaatagataatgagtccttgaagtggtggatctttcggaaactatatagcgattcccacgtcagacagttggatccagcgttggatctactatccaaatgatccctgtagacctaaaaatattccacctaaaatattccataagcagtatgtaggtactggagtcttcattatgaaagattaaaacattttgctgtcaa

SEQ ID NO: 51421 - DNA, 274 bp, Homo sapiens
catgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccagacggagtctcactctgtcaccaggctggagtgcagtggcatgatctcggctcacggaaacctccacatcccaggttcaagcgattctcctgcctca

SEQ ID NO: 51422 - DNA, 150 bp, Homo sapiens
ctctgatgttataatttcataaattttgtattttttgtaccttttgcagcagttgctttagggcttttaaccacaatgttattgtacctgggagtggagataactttttcaactaaataatgttttagaaatgacaattttggtattcaa

SEQ ID NO: 51423 - DNA, 447 bp, Homo sapiens
  misc_feature (42)..(42): n is a, c, g, or t
aatcacctggacctcccgtttggtggccccaaagtcaactcnaaagttggttcggaactgagtttggtcatctttctcccatgaacctcctcctccaccttccctcctctagggactccaccataatttacagtcacagaagccagcagccctggggactccacctttctcacacctcaagcacccatggaatccaccgccccaacacccagccttcatcttaattcaggcccccatcactgcttgctaccaattgttacaataattttctaattgtctccattctctacttgctgccagagtgagcattctaaagcacaagtcgaatttgcatctctcttgctttaaaataaagtatgcttttagctatttgccattatttacagcagtgctgtctaatagaaatataataggggtgatgtatgtaatttaaaaattttttgagac

SEQ ID NO: 51424 - DNA, 201 bp, Homo sapiens
tccagtatacaggatgaaatagggatcctagccatactttcccctcattggttgggggccccagtgagtagcctcctcctccaatggtgtaaaatgctactttccccataatgtcagtgcttataaggaacacatctgggactatttctggactttctattctgtctcatccacagtgggatgctaggacctgtgcacact

SEQ ID NO: 51425 - DNA, 1329 bp, Homo sapiens
  misc_feature (1)..(1): n is a, c, g, or t
  misc_feature (118)..(118): n is a, c, g, or t
  misc_feature (1109)..(1109): n is a, c, g, or t
ngtgtatttcagcagtataccacagctatttaatgtgtatttcagcagtataccacagctatttaatgtgtatttcagcagtataccacagctatttaatgtgtatttcagcagtatnccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatatgtatttcaaaatgcaggcagtccttgctttgcatggtaatgtggagccataaaaatgaccatgctgctgagactctgcaaagcaatgttaatcatcagtgaagggaaattattattctgtgacctttacatttttttgtgaaaatattaaaaactgcaatagtcaactataaaggtacaaattaggaaaaagtgaaaaatatattaaagttaatattgttaatacatggtaatttaaaacggaaacattgataatgttttacttatttgcaaaaaaaaaaaatgtatcaaagagaagaacaatccaaacctaaagcaaacagaagggtggaaataataaagattagagcagaaattaatgaaataggtaatagaaaagatgtaagaagacagacaaaactgaaagttggtcctttgaaaaaaaaatcaacaaaatgacaaaccttcagaccagccaagaaaaaagagagaaggctgaaatttctgaaagcaagcatgaaagagggaaaacaagagactattatgagtaactatgtgctaatacctgaggtaacttagatgaaattgacagattgctagaaagacataaactaccacttctaatcagtgttatagttgagattctatccagggcaataagaaaagaaaaagaaaaagaaaatcagattagaaaggaagaaataggccgggcgcggtggctcacgcctgtaatcccagcactttgggaggccgaggcgggcggancacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctc

SEQ ID NO: 51426 - DNA, 549 bp, Homo sapiens
gtatttttttccattttcttttaaaagatatgcagataggactttttcctctttaactgtcttattttgggagcccccagatttcagggaagagccccacactatatgagcacatgagttggacatttctggttccccgccctgagttggacattgccagtcatgtctgcagaagaaccatcctgcctgttggaagctgcagttttaccttctggttcttgcctgctcatcccctaccatactaagcctccagagtgtgggaatgtgcaccatttcctaactatattaactcactgccaccagtctggtgtgggtgctcagtacaagtgaatcctgaaaaagcctcaggctcttggatggaggaaaactggctgcatttgaaagccatacttcaatttctattggtcactgctagtataaactttaattattgatttaaacaaattttatctggatccaattatgttgataaattatttttaggtttaataatttgttagattcatttcctagcttttctaggtttagaataaataatgatttatttgt

SEQ ID NO: 51427 - DNA, 1252 bp, Homo sapiens
gtaagaatgaggcttggaacgcggagcgcattgtgggcctgtcgtgggtggcgccagcagcacatgcatgcctggctcacagagcagcctttgggtgttcttttcccggaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttggggtaaaatatgattacaataacttgcctattgccgagattaaactttacaggctgcgttattttagctttgtgcttttcctttcataaaattccactcctaagatgtttctgttttctgggagcggggaggtggtttggagtatatatgtaaatctatatccaaatctaaatgtccgtatccagtatgttaaactagaatctaaaatttctggtttgctatatttctttttttccttttcctttaagaccctatcactccacagggaactggtttcttggcaatacagtctgtcagtggcataatggtaactatcttggacaatttcttttacagattggtttgagaaatatatcctgaatgtgggttattatgtacatgagactttaagttgaaaattactcatttttattattataaagtaaatttccctttgcttttaatctttgtacatccttttcagtagggtgtgggattagaggaggggaggtggaagaattataatggtacatttcctatttttgtgcat

SEQ ID NO: 51428 - DNA, 449 bp, Homo sapiens
ctttagaagactagtttgtcttcctttaaggagaagaatatggaagatttgtctttagaaatgtagatgtttggcttttaaaagaataaatggtttgtcttcctttaaaaataggcttttaaagacacaagtaagttttaatttgagtgtaattgtaaggaggccactttctagttcgttggaaaatatgtgttcagaagacaatgtagtatcagtttttgtctgatttttcaagtgttggtttcccttttggttgaacagcagatctttctcgtatatgtgtaattctaaaggattgtacagaaaattaagggagatctaaatacttagatttttaaagtttatctggtgaactctgattttggtgatgataataaatgactgcattgaggataatgcatttcattgttatatcctaatgaagctttagggtcatcttcgcctcagaa

SEQ ID NO: 51429 - DNA, 763 bp, Homo sapiens
aagtggggcctggaatctgtcttgggactctgaaatggaggggggtgattgatgaaactagccctctgtttctcccctctcttttccagtcaaatgtcgctgcctccaatgccaagctggctttgttttatgactggctgttctttagtccagacaaggatagcattatgaacataggtatgtgaccaagaccaggcggctccacttccccatccccctaagcccccactgccttccttagtgatagcagtcataaatctcagggcaccgtggagtggaggcagtttatctgggagcagctctgttgttcctcatcagttttcccttgacctagaaagagaattgctttgataaggctaagccatcactgtacctcctccccacagtcttcaggatgcatggtcttcaggaggggagggcatgggcaaaggaaaaggctgtaccatgtcctgcttctcctcacctattacttcccttctcaaagctgaatgctgggaacaagaagggaaatgagggctacaagctgtttcggggcctgtctgctcttgggtctgctcagtggaaatggggggaatagacatagcacttcccagagccattcatgtatattgacatcccattttatggagatagaaacagactgactttagcctggcgtggtggcgcacacctgtaattccagctgctggggaggttgaggcatgagattcgcttgaacctgggaggcagaggcttcagtgagctgagatcgtaccatttgcac

SEQ ID NO: 51430 - DNA, 332 bp, Homo sapiens
cccgcccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttgactcctctgtgctttggtaataaattgttttaccaga

SEQ ID NO: 51431 - DNA, 4216 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51432 - DNA, 3660 bp, Homo sapiens
  misc_feature (6)..(6): n is a, c, g, or t
gaattnccggggcgcgccccacgcgcgcggaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51433 - DNA, 3450 bp, Homo sapiens
tggtgttatttaagtttaagggattagagggcaaggggtccactgtgggtggggtgaggaccttatcctcagcttgctggctgatcacaaactttacttctcacagtgttaccgggacttagctctggtgagtcgtgatggcatgaatattgtcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51434 - DNA, 4306 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcgtgtaaaaagtattggctctacctcagactgctgggcatatgtcttcttggctcttagaggaatttctctcctgccatcgtattacaaagacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51435 - DNA, 2552 bp, Homo sapiens
gtgacactctgtctcaaaaaaaaataaaaataagagaagctctgatattgaccttcatcatgttccccatttagacacctagctcccctgtttgacaaccctaagttggataaggagctgcgggcaatgctgagagagaagtttcctgagttctgcagctcaccctccccacctgtggaagaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51436 - DNA, 4976 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcgtgtaaaaagtattggctctacctcagactgctgggcatatgtcttcttggctcttagaggaatttctctcctgccatcgtattacaaagacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51437 - DNA, 4978 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcttttgtgctggagtgtctgctggcatttgccccgtgcatgtatagcttggtcttgatttgattggcacccctacttgtaaccgcagaacatccccctttcccttcctgttctgcccccacttttgtctagagcagaagggacttggctttggccactacccatccttcctgctgccactggaggtgggagccaggcactgatctgtctatgcagaaccatcccccgtaggatgaggcctgtccttactcatttctcaagaaacaagatgcttccaaaaggtctgtcatcctccagttgaagtctgtgtgcctaccaagaatggccggaggactccgctgcttgacgggagggatgctccagcttggtctccagggacaactgtacctggagataaagtctggataccagggagggacagagatgctcttccttccacagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagcaaaaaaaaaagaagacaacaacaaaaaaacagg

SEQ ID NO: 51438 - DNA, 4838 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccatgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51439 - DNA, 5100 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaagtgaggctcctgccacttatgggccttggaaagtagtaggggaaaagcctaagggagaggaagcctgctagggacataaacgtaatggccagcaagaccttagggtccagggttgaagaaaaagaaggcctaggcctgggggcagagaagaggatgggaggtgccgtaggagcagcaggctcccactcaaagagctaccgctccttttccttagattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51440 - DNA, 2673 bp, Homo sapiens
ggacgcgtgggtcgacccacgcgtccgatattcaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51441 - DNA, 3908 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaacagcagtgtgaggggctggaggccccaggaggagggaaggagctaggggctgcatagtcagccttctcaaactcagccagaggagaaaagctcctccttccaccggggaagcatggggatgcagcaagtgtagacctggggt

SEQ ID NO: 51442 - DNA, 3791 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagcaaaaaaaaaagaagacaacaacaaaaaaacagg

SEQ ID NO: 51443 - DNA, 2418 bp, Homo sapiens
caagagtgcgagtagaggccggtgtgaattcggagaggctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51444 - DNA, 2513 bp, Homo sapiens
tgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgctttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51445 - DNA, 3249 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaaatcgacatgttcgggggtcctctagg

SEQ ID NO: 51446 - DNA, 1989 bp, Homo sapiens
aacctgcgacctttacacagggaacagctttagcctgttatcgaatggccacaacgatagcgtgaggctcctgccacttatgggccttggaaagtagtaggggaaaagcctaagggagaggaagcctgctagggacataaacgtaatggccagcaagaccttagggtccagggttgaagaaaaagaaggcctaggcctgggggcagagaagaggatgggaggtgccgtaggagcagcaggctcccactcaaagagctaccgctccttttccttagattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51447 - DNA, 3021 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagtcccaggagctgggtctgccagtgatgatgggtacctgggtatgttcggaaagatccagtctcaaattatcattcagagcctaactgggaaaccttgtgcagtttggccggagacctttggcacaaaattcccgtgggacaataattcccagaacgggagacgaccataaatatagggacccccaaggcgccgcgcggggacaagcggacaccaccaaaaaaagcagcgggacgacgctacatagcagttggtcgcgacgcgacacctaacatacaaaaccaaccatcggcagggcacaataacgaaggtggcagcaaaaccactcaagaagcgggcgacacagagcgaacagacgcgtcgacaaagcagagtggaccgacaaacaagccatgagcagaggagcacaacgaaccgatagcccgtagagta

SEQ ID NO: 51448 - DNA, 2628 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgccgcatgagagagactgactgtcggcaaaaacaaaaccaaaaccaacctttacccacttctcctaaacacccctaaaaaactgctctgaaaagcagggaatatcattgtgcaaactgattccttgtgttgtacacggctgtcatgtgatcacgtactcactggtatacctgtttcctgcattacc

SEQ ID NO: 51449 - DNA, 1126 bp, Homo sapiens
agtcagagctctgatagcgcattgtatattcacaataatgtgtaccgagcgcgatgttcataaactacgtgtacctggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcttttgtgctggagtgtctgctggcatttgccccgtgcatgtatagcttggtcttgatttgattggcacccctacttgtaaccgcagaacatccccctttcccttcctgttctgcccccacttttgtctagagcagaagggacttggctttggccactacccatccttcctgctgccactggaggtgggagccaggcactgatctgtctatgcagaaccatcccccgtaggatgaggcctgtccttactcatttctcaagaaacaagatgcttccaaaaggtctgtcatcctccagttgaagtctgtgtgcctaccaagaatggccggaggactccgctgcttgacgggagggatgctccagcttggtctccagggacaactgtacctggagataaagtctggataccagggagggacagagatgctcttccttccacagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagcaaaaaaaaaagaagacaacaacaaaaaaacagg

SEQ ID NO: 51450 - DNA, 716 bp, Homo sapiens
  misc_feature (41)..(41): n is a, c, g, or t
  misc_feature (45)..(46): n is a, c, g, or t
attaactgggcagcgagcttttgcatctccggcacatatcntttnnacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgccgcatgagagagactgactgtcggcaaaaacaaaaccaaaaccaacctttacccacttctcctaaacacccctaaaaaactgctctgaaaagcagggaatatcattgtgcaagtaagttgttttttccacgggtctgtctgcataaaacttgccacttagagctcgcctgcaccatcg

SEQ ID NO: 51451 - DNA, 1962 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggatattttacacagcaggaaagatatgaacaatacggagacggctttcagtgccgtatgaagttaggattttaacagctataggataagtgagagggagatgcgattccctctcatttcgg

SEQ ID NO: 51452 - DNA, 1493 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacggtgagggcaaaagatactgggtggtgaagggtgcctcttccatggtgttcccatgtttccattctt

SEQ ID NO: 51453 - DNA, 689 bp, Homo sapiens
tagactgattgtgcttagacctatctcaactccatgttgagttagaaatgagaagctctggccagacacagtggctcatgcctgtaatcccagcactttgggaggccaaggtgggcagatcacctgaggttaggaatttgagacctgcctggccaacatggcaaaacccgtgtctactaaaaatacaaaaattagccaggtgtgatggtgcacacctgtaatcctagctacttgagaggctgaggcacaagaatcgcttgaatccgggaggtggaggttgcagtgagccgagattgtgccactgcactccagcctaggtgatgagagtgacactctgtctcaaaaaaaaataaaaataagagaagctctgatattgaccttcatcatgttccccatttagacacctagctcccctgtttgacaaccctaagttggataaggagctgcgggcaatgctgagagagaagtttcctgagttctgcagctcaccctccccacctgtggaaggtatgaggcccgcccattccatcacctgtgtcaaaagaggggcaagacaaccaggccttcaggccagagcccctttcaggatgtcccacacagttctccacttccgtgacactgtccatcacagtttttccttcctcagtttatcttttttattcatttttgtgttgtctgtcttgattctc

SEQ ID NO: 51454 - DNA, 354 bp, Homo sapiens
tagcacagggcatctggagccagcaaagcagttttagagcgggagcctgcttcggggatgcttgaaggtgggcactggggtcaggctgctggctcaggcccagctggtcttgcagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagaggtcagtgcctgcatccgtatctgtgccggggggctcacaggaacacacctcagtgaacactctgagtacacacaaccctgaaccc

SEQ ID NO: 51455 - DNA, 393 bp, Homo sapiens
cggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcagg

SEQ ID NO: 51456 - DNA, 393 bp, Homo sapiens
attctttttttccccttttgaaatcaggtggagatgttacagccaaaaatatctggttggcagaaagtgttctggatatcctgacagagcaaaggtagcatccaccacgaagggtggggtacaggccagataatggccattaggagtgtgggtgtgggaaatggggatgaaaggattgtgtggcccaagaacaccttaagttagagagggggaggcaaggagagggagagacaagtgtattgttggcaagtgaagaaattaatgcccaaggaatgaaggaatgggaaagaggtctttgccaaaatatcgcatagcccagaaaaactggcttcatctgataagggtttatttttgatccagacctccttggaatgtttatcttagggggaagtt

SEQ ID NO: 51457 - DNA, 664 bp, Homo sapiens
cccgcccttccactatggccgcttctgtgtggtgtggggagacgctggtcctccccgtcctcccatagcgcttattgcctcaccctcaccccctaggggccggatccaaaggcgctgcactccccaagccttggggcatcagccaggaagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttataggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcag

SEQ ID NO: 51458 - DNA, 4235 bp, Homo sapiens
cccgcccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccataggggcacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttataggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51459 - DNA, 3122 bp, Homo sapiens
tcggcacgaggaatcctcaggccttgagtcctcagttgcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51460 - DNA, 2832 bp, Homo sapiens
catccggtaccactagtcacggttggctctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51461 - DNA, 2676 bp, Homo sapiens
gagacagagtctcgctgtgtcgcccaggctggagtacatgttgctcttattcctggcaacatccctctgcaggtcatggagggttgtgaggacaagaggtttgtcaagaggtttgtcctcccagggtcagtattccatttagatgataaactccttattctctcacttgccctccattctcccttcctagaagcatggggcatgttagaggacccaggaggccattaaatgccttatctttttttactcccaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 51462 - DNA, 4203 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttttttttttttttttttttatattttttttttatacaaaaaaaaagggc

SEQ ID NO: 51463 - DNA, 5084 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaactgtatgccttccaccctcggcgtccagtgtagacggtgctgccctggcccagactatgcctggagccaggctgggggcaggggcaggacacccggggccacaacccacactcgggataaaacaacctgtgcgtgctgtttaataagctcccagacatctgattgtttttccttccctgctctcccttttcttcctctagtttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51464 - DNA, 2342 bp, Homo sapiens
ctagaggatacccgaaacactgtcgatggctgttatgactctgcacactccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaacaacaaaaaaaaataaacaaaaaacaaaaaaaaaaaaaaaaaaaaacaaaaaaaaaaacaacaaaaacaaaacaaaaaaaaaaaaacaaaaaaagaagggagcggggcgcggcgcgagaggagaagcatccacacaacgaggcgcgagggagcgaacgacgagaacaaaagacgaagcatagttagaagaggaagaggcgcggcgccgcaaacataggggagggaacgatagcgaagagaggcgagggaggagcgggagggtagaaagaaaacgaacgcacgaagggagagacgagagaaagaaaaaggaagtatgagctgagagaaggacagataatagggataagggaagggcagaaactaacacatgagtgtgagggaggaagaagaaacatcaggaggggcagcgagaaagatcacagacgtacagcgaaaggaggtaagagagggcgggagtagggagaaaagaataagagaaggaagtaaggaggagggatatgagagagagtgggagagcaacaagcaaaagagagatagtttatatgatgcggagaggtaggaggaaaagacggtagagggagacgagagcagtaggtgataatataagcaagaagacaaataatcatatacaaaggggaggg

SEQ ID NO: 51465 - DNA, 2622 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgccgcatgagagagactgactgtcggcaaaaacaaaaccaaaaccaacctttacccacttctcctaaacacccctaaaaaactgctctgaaaagcagggaatatcattgtgcaagtaagttgttttttccacgggtctgtctgcataaaacttgccacttagagctcgcctgcaccatcg

SEQ ID NO: 51466 - DNA, 2551 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgctccgccctgcgcatgagagagactgactagtcggcttccacggtccaaaactaaccccacacactgctcctaactaaacctttttcctggtctgaaaagcaggcact

SEQ ID NO: 51467 - DNA, 2101 bp, Homo sapiens
atattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacaaagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacataggtatgtgaccaagaccaggcggctccacttccccatccccctaagcccccactgccttccttagtgatagcagtcataaatctcagggcaccgtggagtggaggcagtttatctgggagcagctctgttgttcctcatcagttttcccttgacctagaaagagaattgctttgataaggctaagccatcactgtacctcctccccacagtcttcaggatgcatggtcttcaggaggggagggcatgggcaaaggaaaaggctgtaccatgtcctgcttctcctcacctattacttcccttctcaaagctgaatgctgggaacaagaagggaaatgagggctacaagctgtttcggggcctgtctgctcttgggtctgctcagtggaaatggggggaatagacatagcacttcccagagccattcatgtatattgacatcccattttatggagatagaaacagactgactttagcctggcgtggtggcgcacacctgtaattccagctgctggggaggttgaggcatgagattcgcttgaacctgggaggcagaggcttcagtgagctgagatcgtaccatttgcac

SEQ ID NO: 51468 - DNA, 145 bp, Homo sapiens
tggtgattcctgcacagcctgaggagctctagcagcaagctggcccagctgactctggagcagatcctggagcacttggacaatctgcggctcaacctgaccaacaccaagcagaactgtatgccttccaccctcggcgtccagt

SEQ ID NO: 51469 - DNA, 526 bp, Homo sapiens
tttcagtgagaccctgacagtaaatgaaggtgtgtttgaaaaccaaacccaggacagtaaatgaaggtgtgtttgaaaaccagccctaggacagtaaatgaagccatcttctcactgcataaactgcacccagatctttgcccatccttctcagtatttcacttcacccattgtttactgtctcaatgactggggaaatgtctggggaaatgctcccgtaattgcacagtggcgtttttcctggaaaatcccaccatggctctagataagacctatttttcttaaaggtatctaaaatttccagcataaattctgtctgaaacacctgaattttaatcagtactggagcccggagggcatctccagttgccacatagctctgagcattcagtggtgtgttgagggctgctcccggaagtgcctgcagagtcagggctccccagcctcatctagtgaggcagtggaagggcctgtggggatttggagagctggcctgggtctctgaagtgatagtgacagctgcttg

SEQ ID NO: 51470 - DNA, 389 bp, Homo sapiens
cttagagatgctgcagtccaggcctaaatttatagagggagaccctgacacccaagaaagacaagtgccttccccaggatttcatagctcaggggaaagctttcacattttgcccttactatctgatggcaaactttaaacctcagaaagaaaagcaactaccatttggaaagaaacaacagcacctcattcgacaatgttttgcaattttttttgcaaggaaatattgtattaaggttaaaattaaaggctaaatataaaagtcccatattttgacatttaattcagatgccattttgtggttgctagaatggaggaaagcctattgcagtgtaaattaggatgattttgctcacactaaagaggacatggtcccagcctgaggccat

SEQ ID NO: 51471 - DNA, 207 bp, Homo sapiens
aatatgtttatcaggttcatacgtcaaaattacatatatacatattttgacagtctacagatggtatccatgagataagaatatactagatgtttgaaattacagctagttgtgaaggctttgccactaattcagtgtgacacgtgggcaagactgtcttctctggatctcattttcttatggaaaactgggatggttaaaactagg

SEQ ID NO: 51472 - DNA, 195 bp, Homo sapiens
taaaggacaaacattctaaccatagcaggagttccctatttccattaagacaaatttcaggattttagaaatgattgtttctgcttttggtttgtgcctttccacagtaacattattacagcattgttccaaactatctacaccaaatcaacagtaacgattttagctgtcagataatttacagcctgagtattt

SEQ ID NO: 51473 - DNA, 2121 bp, Homo sapiens
cacttaacacactcttgatgacatatggcaggttcttggtattgacacccgtgtggctgcaggtggcatgaatcatgcatggcttgtctggatctgtcttctgcagagcccattctctctgtcttttgctagtctggactggagagcaacttccctgagtcaggactcttgctgctaattgcagaaaaccagcagtctctgtgaagttgtggtgttctcagagttcagctgtaaaatatagaatcctcattaattgtatttacaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcagtttgattttcaagaggcagtgaagaatttcttccccccaggaaatgaagtggttaatggagaaaatttaagctttgcatatgaattcaaagctgatgcattatttgatttcttctattggtttgggctcagtaattccgttgtaaaagtaaatggaaaagttcaatagatgatgtttttaactgcaatctgtcacccagatcatctctgacagagcctcttttggcagaattaccatttccaagtgttctggaatctgaagagacacccaaccaatttatctgattgaactgaacattgtagcagttgctcccgcactccaggcctgtgctagactataggctggggggagggtaggaggtgggaggcagatacttccacctgcgtgtcaatctccggctcctccatggcttctatggaggactcctctcttctgcttctgtggatgtgatgccctggcaggcccagggcagctgattcccctaaaacttatgattaccaggatggaaaggccttggtcccatggcactgggtggggctgggggatattctctactttgaacacttctccaaagaggcagaagggccacagagttctgccaccctgaacatttttctcagttccctgggagtttttgtggcagcctttgtgggagtggtctgactggctgttgacctagcatgcttcataaatcagggtttggccctctgcttggagcatccaaccccttgaactcaaacctgtcgagcaaggggttaagagttctgttctcttgccaacctggctgggcaaaagcctgtgccatctttcactgggaggcaaatatgtttttcatcctgccatatgacacctatgagaaacgttcacagtgaggagtagccaggttgctaggacagtaaccctgccacacactgcctgaaatcggaactcccttggcctccctcttaactaagtgacccatgtagaaggaagccaggagatatggtaccgaacaatgacaggggaagggtattggacacggcagcgtcctccttattgaaaacacattatgtcagttgggaattttaaataagcttttagcaaacctaacactaaaagcaaaatagaagaaagctataccattaccataatacatttttcatctcatggctacaatggaattcttgaaaaggaaaaaaaaatcctatctacatataaaaacctgcatgaatgaatcactacatatgcttataatgaggaagagttatgggtcctgagtgtaattttttatcctttcttaaaaagtttctgtattatgcattttgataacactactgatgatccttccacttatatttgaaatgttatgtaccacatttgcacaattaaaacttttcttagcattcaacctagaattgattaaatttatgactgaggcttcatgtgagctttccattgtggtttgtgggtgttgtatttgccttgtaacttactgaattacaataagaattgtgggttttcatagccactttctcaagaagcgccttttgaagaacaaggctatgaagtatttgaagaaaggaaataaaatttgatactgatctttcagaaaagagaaggggaatgctacttaataacagaagatgttaaacatttattattacactcaataaaaaatgaagagtattaacaataaactaa

SEQ ID NO: 51474 - DNA, 2521 bp, Homo sapiens
agcgagtggcagcttgggaggggccgcccgggcggtcagactggcacctgagcggccaccgcgtcccggccaggcgggcagaccgaccccctcctcacctcgcgcgcggctgacgcaggcagggcgcccggcccctcctggggaccatcaggtgccggctgggggctgtaggcaccggacggaagcaggcggtgtgaggaccgacgacgcgggcatggcgggggcggcctgcgagccggtggccaggccgagcctgacctccatctcgtctggggagcttcgcagcctgtggacctgcgactgcgagctggccctgctgccgctggctcagctgctgcgcctgcagcccggtgccttccagctgagcggcgaccagctcgtggtggccgggcccggggagccggcggcggcgcgggggggcttcaacgtcttcggtgacggcctcgtgcgcctcgacgggcagctctaccgcctcagcagctacatcaagaggtatgtggaactgaccaactactgtgattataaagactacagggaaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcagtttgattttcaagaggcagtgaagaatttcttccccccaggaaatgaagtggttaatggagaaaatttaagctttgcatatgaattcaaagctgatgcattatttgatttcttctattggtttgggctcagtaattccgttgtaaaagtaaatggaaaagttctgaatttgtcaagtacaagtccagaaaagaaggagacgattaagttatttctggaaaaaatgagtgagcctttaatccgaagagcagtttctctgaccgaaagttcagtgtaacttccagaggttcaatagatgatgtttttaactgcaatctgtcacccagatcatctctgacagagcctcttttggcagaattaccatttccaagtgttctggaatctgaagagacacccaaccaatttatctgattgaactgaacattgtagcagttgctcccgcactccaggcctgtgctagactataggctggggggagggtaggaggtgggaggcagatacttccacctgcgtgtcaatctccggctcctccatggcttctatggaggactcctctcttctgcttctgtggatgtgatgccctggcaggcccagggcagctgattcccctaaaacttatgattaccaggatggaaaggccttggtcccatggcactgggtggggctgggggatattctctactttgaacacttctccaaagaggcagaagggccacagagttctgccaccctgaacatttttctcagttccctgggagtttttgtggcagcctttgtgggagtggtctgactggctgttgacctagcatgcttcataaatcagggtttggccctctgcttggagcatccaaccccttgaactcaaacctgtcgagcaaggggttaagagttctgttctcttgccaacctggctgggcaaaagcctgtgccatctttcactgggaggcaaatatgtttttcatcctgccatatgacacctatgagaaacgttcacagtgaggagtagccaggttgctaggacagtaaccctgccacacactgcctgaaatcggaactcccttggcctccctcttaactaagtgacccatgtagaaggaagccaggagatatggtaccgaacaatgacaggggaagggtattggacacggcagcgtcctccttattgaaaacacattatgtcagttgggaattttaaataagcttttagcaaacctaacactaaaagcaaaatagaagaaagctataccattaccataatacatttttcatctcatggctacaatggaattcttgaaaaggaaaaaaaaatcctatctacatataaaaacctgcatgaatgaatcactacatatgcttataatgaggaagagttatgggtcctgagtgtaattttttatcctttcttaaaaagtttctgtattatgcattttgataacactactgatgatccttccacttatatttgaaatgttatgtaccacatttgcacaattaaaacttttcttagcattcaacctagaattgattaaatttatgactgaggcttcatgtgagctttccattgtggtttgtgggtgttgtatttgccttgtaacttactgaattacaataagaattgtgggttttcatagccactttctcaagaagcgccttttgaagaacaaggctatgaagtatttgaagaaaggaaataaaatttgatactgatctttcagaaaagagaaggggaatgctacttaataacagaagatgttaaacatttattattacactcaataaaaaatgaagagtattaacaataaactaa

SEQ ID NO: 51475 - DNA, 2548 bp, Homo sapiens
agcgagtggcagcttgggaggggccgcccgggcggtcagactggcacctgagcggccaccgcgtcccggccaggcgggcagaccgaccccctcctcacctcgcgcgcggctgacgcaggcagggcgcccggcccctcctggggaccatcaggtgccggctgggggctgtaggcaccggacggaagcaggcggtgtgaggaccgacgacgcgggcatggcgggggcggcctgcgagccggtggccaggccgagcctgacctccatctcgtctggggagcttcgcagcctgtggacctgcgactgcgagctggccctgctgccgctggctcagctgctgcgcctgcagcccggtgccttccagctgagcggcgaccagctcgtggtggccgggcccggggagccggcggcggcgcgggggggcttcaacgtcttcggtgacggcctcgtgcgcctcgacgggcagctctaccgcctcagcagctacatcaagaggtatgtggaactgaccaactactgtgattataaagactacagggaaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcagtcaatgcaatgttcctctctctttcagtttgattttcaagaggcagtgaagaatttcttccccccaggaaatgaagtggttaatggagaaaatttaagctttgcatatgaattcaaagctgatgcattatttgatttcttctattggtttgggctcagtaattccgttgtaaaagtaaatggaaaagttctgaatttgtcaagtacaagtccagaaaagaaggagacgattaagttatttctggaaaaaatgagtgagcctttaatccgaagagcagtttctctgaccgaaagttcagtgtaacttccagaggttcaatagatgatgtttttaactgcaatctgtcacccagatcatctctgacagagcctcttttggcagaattaccatttccaagtgttctggaatctgaagagacacccaaccaatttatctgattgaactgaacattgtagcagttgctcccgcactccaggcctgtgctagactataggctggggggagggtaggaggtgggaggcagatacttccacctgcgtgtcaatctccggctcctccatggcttctatggaggactcctctcttctgcttctgtggatgtgatgccctggcaggcccagggcagctgattcccctaaaacttatgattaccaggatggaaaggccttggtcccatggcactgggtggggctgggggatattctctactttgaacacttctccaaagaggcagaagggccacagagttctgccaccctgaacatttttctcagttccctgggagtttttgtggcagcctttgtgggagtggtctgactggctgttgacctagcatgcttcataaatcagggtttggccctctgcttggagcatccaaccccttgaactcaaacctgtcgagcaaggggttaagagttctgttctcttgccaacctggctgggcaaaagcctgtgccatctttcactgggaggcaaatatgtttttcatcctgccatatgacacctatgagaaacgttcacagtgaggagtagccaggttgctaggacagtaaccctgccacacactgcctgaaatcggaactcccttggcctccctcttaactaagtgacccatgtagaaggaagccaggagatatggtaccgaacaatgacaggggaagggtattggacacggcagcgtcctccttattgaaaacacattatgtcagttgggaattttaaataagcttttagcaaacctaacactaaaagcaaaatagaagaaagctataccattaccataatacatttttcatctcatggctacaatggaattcttgaaaaggaaaaaaaaatcctatctacatataaaaacctgcatgaatgaatcactacatatgcttataatgaggaagagttatgggtcctgagtgtaattttttatcctttcttaaaaagtttctgtattatgcattttgataacactactgatgatccttccacttatatttgaaatgttatgtaccacatttgcacaattaaaacttttcttagcattcaacctagaattgattaaatttatgactgaggcttcatgtgagctttccattgtggtttgtgggtgttgtatttgccttgtaacttactgaattacaataagaattgtgggttttcatagccactttctcaagaagcgccttttgaagaacaaggctatgaagtatttgaagaaaggaaataaaatttgatactgatctttcagaaaagagaaggggaatgctacttaataacagaagatgttaaacatttattattacactcaataaaaaatgaagagtattaacaataaactaa

SEQ ID NO: 51476 - DNA, 334 bp, Homo sapiens
gtggcattattgctaccaataaaatgagtttagttcttagcaacctattagaaatgggtaagaataaatgtaattttggccaagcagttcagaatttttagatggaatatgatgcaaatgcaaagttttgttagaaaaaataaagacaacagtttaaaaatatgtgtgagagtgaaagggaaataagaggtgtgatgttttggatatttaggcggttgttagttctacaatgtcaacaggatacttatgtccattaagtcaatgcaatgttcctctctctttcagtttgattttcaagaggcagtgaagaatttcttccccccaggaaatgaag

SEQ ID NO: 51477 - DNA, 621 bp, Homo sapiens
  misc_feature (47)..(47): n is a, c, g, or t
  misc_feature (104)..(104): n is a, c, g, or t
  misc_feature (148)..(148): n is a, c, g, or t
  misc_feature (240)..(240): n is a, c, g, or t
cacagtggttaatactgcaagctctgtagccaacctgcctgggtcangatacacctcaggttcttaattgctgtgttacctgaggcaagttccttaaactctcncgtgtttcaatttgcttatctctaaaataggataattaactgcnacctgcctcatagggccttgggagaattcaatgaatgagcatacaaaaagatcttagaacacctggcacatagcaagtaaattttttaaaancgttagttaatatgattaatacaatgatccacataaccacgctgcgggatgaggagacacactgctgttatctgatttgattgatggaaactgaggcagagagagatggaccgagcagaagcaccaagccagcaccagcctcttctgtccccacaagtcggcaagcaccatgccacatcactgaaattccttcaagccggggggctctttactaagctgaatataatcacaaatactacccacctctgatatttcccatctctgtgatgaggatggatgatacattgtaaagtgctgagagcacctcacagacaagtgtgatataaattccaaatgtcattttaacgttctcattattattattaaaatggccaaaatgcg

SEQ ID NO: 51478 - DNA, 639 bp, Homo sapiens
ctttttctccacaacctttctaattaaacagaaagaacaaagtctaagtagagtgggccaaatggatgaagtattattgtgagatatgagcacctgctttatctacaacagggctccaggagcctcttacattccttagggaagaatagcccatactgggccctaaggcaaatccacaagtagagctacagctcaatcaggacaggcattcccccgctccccgatcgatctctgtaatgggtagcagatggcgatggttccctggattactagagaagggtttcttttttatttattcgtatttcgtctgttgggttttgtactatttaaagaaaccaccttcagtaggacagattttgcagtccaggggaaaaattcagaatatgggccatcccaagtatagatgaaacattgttggaattctcctcacctggctgtatttttaaaattcagtaaatacgctgtgttcctctcaaagcctttcttaagtgtgcaagtaaaagagagctgtttttctatggatatgatctgacctctcgtaggacacttagcactttccactatgtgctgtgcttatgtagatgacttctctctccttctggaaaacagaaaccatgtgtcagcttcaaaattgcattc

SEQ ID NO: 51479 - DNA, 373 bp, Homo sapiens
cacaaacacacatgcacacacacatgcacacacgcacaaacacaaaaccatacacacatacacacattcacacaaacatgcacaaacacgtgcacaaatacacacacacacacacagacacacgaaaaggacaagtctcctgatgcttgtccagcgtgcctcctcaccccgggcatgcagttcccagacatgctggctgaggtcctggaacacatacccagccacccaaccatcagaattcacactcccaggccaagagagactccagagagtgctgacatgcatcactaccagggaccctacaggacttaggtccaaggtcctggacaagcacttcataatatttagtgacttttgagttgtgcaatttctt

SEQ ID NO: 51480 - DNA, 346 bp, Homo sapiens
gacaggaggccccattgtgcaacctcttatatagcaaattagagtttaccaggaagtttctgcccttcaggccctctgctctcacagaaactctatgaaggagaggtcatcttgtctatgtttgtaagaagtcacattgagagaaatgacatcttagctcctcttatgtgccaagtagtttgtctgcgttatcttcttagattggctccatctctcaggtgaggaaacagacttggaaaggtgaagtgacttgcccacctagttagaagcacatcatcttctgattcctgtctcatttcatttcaccgcttgtttgccctctctgtggtcttgcccacggacttgt

SEQ ID NO: 51481 - DNA, 517 bp, Homo sapiens
ttcctgctaaaggttttgaatttatcctgaagcctattaggagctattcaaaaatttttaagtgtgaaggtgatatgatcagattgcatttagaaaaatctctttgacatcatgatgaatgatacagctgtagagagatcagttgtaggaacttaagaaatgatgagggctgggaataggtaattacaatagacttgaaaggaagtgaataaattccaaaagtattaagatgggttagaaaaaactagatgctgaattgaatatgaagcaggatgataatgtaatttattgaagcattcattgagatagggaaataggttgataatcaggattggataggagtaggggtgggaaggaatatgtcctgcccatgagtcatcaggtggaactatccagaagcaagtacttattcaggtccaggtcctatcaagaaatgtggcttaccaggagtttgaggctgcaaagagctatggtcacaccactgcactccagcctgggtgagagagaccctgtctct

SEQ ID NO: 51482 - DNA, 628 bp, Homo sapiens
gaatgatttacacttaacaagccttgaatttgtaaaaagaaaagccatatttaactggtgcaaactgctccatgaacttaggattcaaatgtcacaattagtatttttaaaaattaatcactcaaatatccacttgccttattagcagaaagtacaccatctttctcttggaatttctgcttttctctgaattcttccagaactttagtgacttacactgactgggttaatcagtggcctccatatccaagatgggtgtgggtcgtgtatccatgcatctgtatatatgtatgtgagggagacacactagagtctgttcagtccaccactgccaccgtacttccctgccccatggtagaatgttgaaaaccagtcttaaactgttcaacaggagctataggttcactgttgactcagatgtttgtgcaggccaccacagtgcatcagggagggatcttccggtgctaagctcggtcctttatggttgagcacccaagattacaactattagcacccagctcttagagttcacatcatggaaacttctcaactattgttctaagtgcactgtaaacactgagtcaggactagttctaacatctaccacctcatacccttagaaccatat

SEQ ID NO: 51483 - DNA, 939 bp, Homo sapiens
aattgagtatctggcaagagtaagattaagcagtaatttgttccaaagaagaatcttctaccaaggagcaactttaaagaatgaaattaactttcttcttgggcctgttggctcttatttcatgtttcacatgaatcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaata

SEQ ID NO: 51484 - DNA, 883 bp, Homo sapiens
cgcgcccgccggccgactaatccaacctaacacacaccccgaggtgacacgagcgagcaagctagcggctacaaatgaatcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaata

SEQ ID NO: 51485 - DNA, 828 bp, Homo sapiens
  misc_feature (44)..(46): n is a, c, g, or t
  misc_feature (68)..(68): n is a, c, g, or t
atgatatacagatgaacaatgtatcacacacaattaaaaatacnnnggccgcctttgcaggatgcagnatgaatcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaacacaaaaaattcggctcgttggccctcacggcggagctctgcgg

SEQ ID NO: 51486 - DNA, 829 bp, Homo sapiens
  misc_feature (69)..(69): n is a, c, g, or t
ctataatctaatatacaacttatcctccacgatattgtcataaacactgtccccttggcaggatacagnatgaatcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaacacaaaaaattcggctcgttggccctcacggcggagctctgcgg

SEQ ID NO: 51487 - DNA, 420 bp, Homo sapiens
caagttcaagcccaggactggggaatgagactgcttaggagttcattcatccagccaacacttctttaggccagatgctgtgtggggactggggaatgagactgcttaggagttcattcatccagccaacacttctttaggccagatgctgtgtggggcactgggaaatcaacagcgaccataatgcaatccctgcccttgagttgaccccgtcacctaaccccaggctagtgagaggggagaaataaaataaacagataacagatattagaagtaagatctggtaggagccaggtgagaggtgtgcaaagggcatttggtggcaaaagaagaggagcaagtgagctgagatcatgctactgcattctagcctgggcagcatagtgagactccatctcaaaaacaaaaacaaaaacaaaa

SEQ ID NO: 51488 - DNA, 596 bp, Homo sapiens
ttttcccatttatggaagtagcataaagcctggtgtccagcagaggggtgcaaaaagggaggagaattgggaagccagagtgttttggcaaagggctgacaatgtgcctcatggagaggattcctatgccactgggtagggccgttgacctttaaatgccatgtgctctccagaccaagggcagagagagacctcactatggggagaggaggggaagacccactgttcctagaaaatcacaaaaatggcattgccttgagctctacctcagttactacggtatttcctgatcttgcctaacaggattacttccttgaactgtaaaaattcccactgcttcagaatgttctccccagcaagcctgtcccccaagtcttgtaaggctgccagccacactaatcatttttaaatagctgaagggggcccagtatttgatttgattttaaaatggaggccaagaaccttgaaatgaaaggacatggttgaggtccactcctgtcctcactgttctgatgatgataccttgatcccacctggggccccaaaatgaagcagtgtcgttcatctggggtaagacccaaggatcattgcctcat

SEQ ID NO: 51489 - DNA, 166 bp, Homo sapiens
tagattatctataattggatatcatctatattgccatacataaaaatagctatagaaatatgttcattcaagcagaaggaatggtgcttgaagaaatacctaggtggaaagacaagtgagccatgtaatgacagatatgtttggtttgtgcaaataatacaacaaa

SEQ ID NO: 51490 - DNA, 116 bp, Homo sapiens
gtatttttatgtcatccaagttaacactccagaaagcctgaaagatgaacatcatcagcaacattttccagaagaaaagctgggactcaaagaagaagttatgtgacttgccaaag

SEQ ID NO: 51491 - DNA, 347 bp, Homo sapiens
aaaaaaaaaagcatggtgtcctggcctgtgtgtcacactcagcatttggcatttgacttcttcacactcttaaaagctattgaggcagttccaagatggctgaataggaacagctccagtctacagttcccagcatgagcgacacagaagatgggtgatttctgcatttccaactgaggggcttgaatggcaaagatgaaaccaagaatgcaaatatcttatccagaaaaaatatatggcatgaggcctacttgtctgcactaagtgtctcaaggggcatggctttagtcaaaccacaactccatgggaactttaattgaagccagagcacttttagtgaaaaagag

SEQ ID NO: 51492 - DNA, 572 bp, Homo sapiens
ttgtcctatagttgattgggttagtggcacctgaaggaaagagatttgccggcattctagtcctcctccttcgtcccccaacctcgaataatcagagggcttagcagcgaggccttttcagctaccaggttctgtcaacctagttaacgctgtgagaaacaggaaaaacgacctgcacgggacactgctttgctaacttcattgggggaacctcagatgcgcctcgcgaactcggagttgcgaacttcgcatcgaacggagatcggcggcagcaaaatgcacgtgggtaccgaatacccggggagggcgtcccgccgtgtccggggcaactacaccgaaggccgagcggcggcttcacggtaccggccgggcaccgccggaggggcccaagccggagctgggagagccgcggcatcctggagcccggcgggcgggagagcctcgtcccatcgctccgggattcctcccagagggaagaaagcgtccgagggccacggcggccggtccgcccagcctcagcgtctcggggagccgggtcctggcccggccttcggcgttgggggcgcgcggcc

SEQ ID NO: 51493 - DNA, 198 bp, Homo sapiens
aaatactttcatcttggtgataaaaatttaggtatcagagcacagtcatttgattaaaaaaagctggactgatataaatgattgaataaaacaaatggggagaagagataaatctccagtgtataattccaagtaattcatatagttatttatccctcaaggaagtagagcataattcaccaccccttaagttgtgcc

SEQ ID NO: 51494 - DNA, 730 bp, Homo sapiens
ggagaccctgaaggaggagcaagttcagtggggaaaaaacaaatttatttttgaacatgttgaatttaaggagtttgtgagcaattcatgcagtgatgagaggtcagttaaatatgcaaatctggtgttccaataagagatctgggctgaaaatacaaatttggaagtctttagaatatgggtggtaattgacaatattggagtgcatctgagcatgtagggagaaagctcagagtgagaaaacagaggcctgatagagtcctgcagacactaaaatgtgatagtttcatacaagaggaggagctttgaaaagagcctggaagtgaccaacgagttggagaaacccaggagagtttgtgttaaaaatgccaggaaagagaatgtctcaagagagtaattgctgctgagacgatgattagtagaactgagaagtgcccattggttttggtgagatagaggtcagacattaccttagcactttttggggaccaagtcgaatcaaagtatattggggagcaaaacttttcaagcttggccatgaagggtagaagagggaatggaagctacagaggggtgtgagattaaggtaaagttgtttttattttattcgaagatattagaaattatgtctttcatgagaaagaactgagtttaaagaaagagaagaaaaaacggttattaatagtgtaggtttttggagatgggaggcaaggctgggaaccagagcagc

SEQ ID NO: 51495 - DNA, 411 bp, Homo sapiens
tgttcatatcctttgcccactttttgatggagagtttgtgttaaaaatgccaggaaagagaatgtctcaagagagtaattgctgctgagacgatgattagtagaactgagaagtgcccattggttttggtgagatagaggtcagacattaccttagcactttttggggaccaagtcgaatcaaagtatattggggagcaaaacttttcaagcttggccatgaagggtagaagagggaatggaagctacagaggggtgtgagattaaggtaaagttgtttttattttattcgaagatattagaaattatgtctttcatgagaaagaactgagtttaaagaaagagaagaaaaaacggttattaatagtgtaggtttttggagatgggaggcaaggctgggaaccagagcagc

SEQ ID NO: 51496 - DNA, 190 bp, Homo sapiens
agcattatcttctccatgagtgaattcatctacttcagaatcaccataactattcatgttacgaattattttaaattataattattgactactattttcaggcaattaatcccttgttcatagcttcagttctttcaaccatcagaaatcttcccctgcatatgctagagatacatcaagtattaaatgc

SEQ ID NO: 51497 - DNA, 440 bp, Homo sapiens
gtttagtcaactttgtcttttctgttctaagttggacacctataagccttcccagtaggacctcttctagctcctttttatcgcatttgtcccccccctctggctgctctccagacactgcagaagtcaggcaccccatccccagcacattcccatgacagccaaatgggcctttggccaaccagacattactctccgtgccctgttcctgcacctcaccccctcggcttggtcctggcaggcatccaagtgactacttagtctcaggcaggttgccctggctggccatctgcaattttttctccaccaaaaataactgatcctgaaacacaacacccttcccccaacaactgggttaattctccagccacttttggtgccaacttacacccccacgcaccagaagggaggtgccagtcgatacaagatttaataacaga

SEQ ID NO: 51498 - DNA, 368 bp, Homo sapiens
tgatccctcacaacaggagttgggggttcttgaccaccattttgcatcatgaccccacccccacctctaaccacagctgatggaactgggatgacacctgtccccaagtaggcgaagtactttctcttagaactaggagtgagagctgctgtttctgtctgggattcttgctggagctcaagtgacacaggcctggggaggtccagagcagtcatcttccatccatcatgtagacaggggagaagagaaatccgctctggaaggagagacgtatgcaaccttcagagagcagagatgagggcagggaccgttcctgctggttccagggctccatacgtcctggcttccaggccctggagaggccccat

SEQ ID NO: 51499 - DNA, 143 bp, Homo sapiens
atggggcctggcagctgctggattaaccttccaaccaaccactgggctgatgtcctgagtcctggtacctccccttcccacaggcccccacctcaacctacagcagaggagtggtctctaaggacctcagtacccagatcggg

SEQ ID NO: 51500 - DNA, 641 bp, Homo sapiens
cccgggtctagttcatttccactcatatctatttctgctaatagattgacagcaacctttggtttaatgctgtgttctctagctacaccaacaagttatatattcctttccaatattaaccaagtatttattttatgttagcctatgactgagttttatctatgcttgcacatatatagaatgtaaaaatataattctccatgtttaatgtatccatataaaaatgaaaatacccattttctgcattcttaaagggttaagaaaagtaacatgtaataagcacatggaggactttagaccatttcttgtgttagaggagactttatacattgtgaggttttctgtcttttggtccttttatgttcttagtccatttcattattgttttaatatttctaccaaggaatgaccaagaaaagagaaaggaagaaaaaaaatgtgttaatcattttcttttaatggtatgtcagcagaaggggttctgactgtaagctaatgtgcacttgtgcctgtcctctttgtcttaaactaaagttggtggtatgaatcgaaaaatgtgtattggtttaaaaagcagtttatgatatgaaacagtcttccagtttttatatcaactcctttgctttcaacagtcagttcaa

SEQ ID NO: 51501 - DNA, 428 bp, Homo sapiens
gggatagaataaatagcctgccaagtaactgaagttatcaaggaaataagtcagaggaggctagtccatttagtccataaaagacctttcattcacagggcttactcaggcaatttctgagaaatcatttttggtttaatttcctcctttgggggaaggagcctggtcaaatctctcaggacagaatactgtataatttcccatcaaagatctcaattattcaaaagatatttaagaaagatagcaccaggccgcgaattaacctgattacttctttgaaccaaaaggaaatggtgaatctagagtcaaaccacatgcaacgctcttcatttgtagctcagagaagaatgaatgatacagtatatttttttccatccatatgggagtacatttaataaagaattttcatctacataatgtagtaaagt

SEQ ID NO: 51502 - DNA, 282 bp, Homo sapiens
tctaagccttctctttatcttaagtaatccactacccctgaaatatgacactgggtctctgaaagaaaaaaaacaacctgataagataaccacctagagtgacatttatataattgcccagtcagaaatcatttccagctgcctacgtggagcttgcttcactgttgtagctaggaaacagggaaggcaaatagctgcttgtctttggtgccaaccttctgaactagtcatgcttaaaggaaagcattcctgtactcgcagttacacagatttgcctcctaa

SEQ ID NO: 51503 - DNA, 980 bp, Homo sapiens
ttcagcttcaattatgtgttgaatttcctcaagtggacgcttaatgatccttctgaacagattgtttatgctgaatgaagcccttcagagagcatttgctcctccctttctccactgctttttgctggtgcactcagctcacagtttttgactaaatgtttgaattttatccacccagcaggcagaaaaatagaactaaaccctccctcccactctctgaagtgctggggaactatctcactggctgtgaaaacaaagggctaatgggcaaacaacagcccccatttcagggccccaaaatagggttcagcaccttgtctgttgttccctttgctccctagatggctaacagtttggagtgggtacagttacccgagcatggcaccttaccaacttatgacctcatgttgttagtcaggttttcctccttaagacgaaagacagaagtagagaacttttaaaattgacttatttttaaggtatattttgggatggcaggtatatcagttaggattaagtttggctgtgaataatagagatccagaatttcagtgctggctgggcatggaggctcacacctgtaatctcagcactttgggaggccaaggtgggagttcacttaagcccaggagttcaagaccagcctaggcaatatagtaagatcctgtctcttaaaaaaaaaaaaaaaaagacagtgccagtggcttaaataaggtagaagtgtatttattcctttggtaacaataataattatgccagctaacttttatgtaatgcttactttatgccaggcactgttgttagcacttttcatatattaactaacttatttaatccataaaatatcctatgacactagtactgatattaccactttaacagatgaggaattgagacacagaaagtaaagccatttgtgcaaagtcacatagctactgaatgacagagccaggacttgagctctgcagcctggcttcaga

SEQ ID NO: 51504 - DNA, 718 bp, Homo sapiens
ttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtggg

SEQ ID NO: 51505 - DNA, 299 bp, Homo sapiens
cctgggcctctggtttgaagtcagccgcccaatggcctcgacaccgtcacctcgcctccagccacgggccatgctccacacgccaccgacactttggccagggggaggggagagatggcttaatcattgcaggccaacacccagcctggatctgcctgatggacaacagtattgatagtctagctgacccttgttcgacaagctgacattccccgtatttcacaggccgacgctggacgtgcatcaaagagactgtcaggtcaccaaacagctaattaaagcaataaagagtcaggaag

SEQ ID NO: 51506 - DNA, 509 bp, Homo sapiens
actgcttaaaaaaaaagtaagatctttactgttctactgattcattggggaaaaaaaagatttggccagctaaagccatgtactgcatgaaacagagcactgtgcataggggacggctccatggactagatcactgaaatttgagaatactatctggttactgatgctccacaatttttttttcaagagaacaggtttttaaaagtctgtaatactttgtgtcacagttgcatttgaaaggattacagtatatagcaaggtttgtaaagataggttagagcaccaagttagctcctaaccagagggcagattggctttcaatgctgattgccaatggtgattgaatagatctaagagcacaataagcaattggaaaggaactcatgtgtgtgtgtgtgtgtgtgtgtgtgtgtgtgtgtgtgtgtgtgtgtgtaaaatgctgcccctacaaagagattaaaatgtgaaataaattaaatcattcataccaaattataagttatattaag

SEQ ID NO: 51507 - DNA, 409 bp, Homo sapiens
cttgtggggcttagcgtccagtgactgttgttttgttttatccttacagaagccctgtaaagatgaaccttatttcccaccattcagcaaacaaggaaacaaatgctcagggtcataaggtatttaactaaggtcacacaattgtccgttccagagaccttactatttccactctctgtgctgcctctcaagggagaccatttcctagatgagaatagccattggtcaatgagctgcagcttatatgggattctctgttggaaaatgacttatgattccttgacttcatgcttagatggctgttagtcaatttgaactaatgaaatgggaatgtatggatataaattttaattgcaacaaattctgaaggactttatatgtgcacattttatattatcagattacactt

SEQ ID NO: 51508 - DNA, 379 bp, Homo sapiens
gaatgtccaagcccaacgttccttacctccagaagagagagaatcctgaggtgctcatgtggagaaacactggccccctgtttgcttctgattttaaccttgtggttgccgtgtctcctgtaacacagtgcagaggaacacctcctctaaattgtgatttctcagatggatgggccccgttgggcagattgtgtttaggactttgtaaccaagactgtcactactgggtggggtggcctggtgcggtctagctcagtaggggaaaagggcagccaccatttccacacctcagcacacacctccatgaaagccaggggctaatgtcccagagccaggccatccgcccacttacccctgtgtgggcagcccttggcctgct

SEQ ID NO: 51509 - DNA, 701 bp, Homo sapiens
gaaacttgtagtacagtagaaaacgttgaaaaggaagtacatgaactccaatattctagacttcacctgcctttgactacaaaataagatcatagttcttttttgtattcaaattataatagttgtattagtccgttttcatgctgctgataaaggcatactcaagactgggtaatttataaagaaaaagaggtttaatggactcacagttccacgtggctgggagacctcacaatcatggtggaaggcaaaagacacgtcttacatggcagcaggcaagagagaatgagagccaagtgaaaggggaaaccccttataaaaccatcagatcttgtgagacttatttactcctgagagaacagtatggggggaaactcaattatcccccacctggtccctcccacatgtgggaattatgggtgctacaattcaagatgagatttgagtggggacaaagtcaaaccatatcaatggtacaagttaaaatctctctctttttcttcctttcttcttcagatgtagctgtcctctgttaatgatagctaccacctgccttcacccttctctactctaggaagaaggaggactactcaagaaaggggaaattgcttccttttgtatcactttaccccacgtgggcatagtacttttctaattttctgcgtatcattatagtcaggctgcaactgttaataacactt

SEQ ID NO: 51510 - DNA, 1944 bp, Homo sapiens
  misc_feature (3)..(3): n is a, c, g, or t
  misc_feature (5)..(7): n is a, c, g, or t
ggncnnncactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 51511 - DNA, 1700 bp, Homo sapiens
  misc_feature (3)..(3): n is a, c, g, or t
  misc_feature (5)..(7): n is a, c, g, or t
ggncnnncactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 51512 - DNA, 2074 bp, Homo sapiens
  misc_feature (3)..(3): n is a, c, g, or t
  misc_feature (5)..(7): n is a, c, g, or t
ggncnnncactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcaggttagcgggacttggggcctagacaagatgggaaggagaaccctgggagccgccgggcagcagtgaggggtgggatgggaacagtcaagccccagtcgctcggtgactgatgtgtgcgcccctcccccagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 51513 - DNA, 1342 bp, Homo sapiens
  misc_feature (3)..(3): n is a, c, g, or t
  misc_feature (5)..(7): n is a, c, g, or t
ggncnnncactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 51514 - DNA, 1855 bp, Homo sapiens
taggtgcatctgattccccactttgtgcttgcagtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 51515 - DNA, 1328 bp, Homo sapiens
gtacagcagtctctcttcttgcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 51516 - DNA, 426 bp, Homo sapiens
cattctcccacttcttttcccacccctcctagtgccaactaggtacggggtcgttctgggagctgtgatcgggggtgtcctcggggtggtgctgttgctgctgctgcttttctacgtggttcggtactgctggctacgcaggcaggcggccctgcagaggaggctcaggtaaggggcggagcctagctcccctccccctctccccactatcccccatctgggcggagactactccagtgggtgggagggccaaggggaagaggaagctgtgtccgcggtgcaaggggttccggcgaggccaaacgtacagcagtctctcttcttgcagtgctatggagaaggggaaattgcacaagccaggaaaggacgcgtcgaagcgcgggcggcaggttagcgggacttggggcctagacaagatgggaagga

SEQ ID NO: 51517 - DNA, 1967 bp, Homo sapiens
tgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagtacgtgatgagttcgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaacaaaaaaaattagccagggcattggctcatgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggagg

SEQ ID NO: 51518 - DNA, 1403 bp, Homo sapiens
tgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagtacgtgatgagttcgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaacaaaaagaggggttgaggagaattccccttatctgttaatctattccagcctttctactaagttacatcctattctctttcaaatattctatctttggctttctcatatacctttactccttttatct

SEQ ID NO: 51519 - DNA, 1834 bp, Homo sapiens
ctcgtgccgaattcggcacgagacaccacgcaggaagaggtcatcatcatgtcggacgatttcttatggtttgaaggcatagctttccctactatgggtttcagatccgaaaccttaagaaaagaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaacaaaaaaaattagccagggcattggctcatgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggagg

SEQ ID NO: 51520 - DNA, 1914 bp, Homo sapiens
tgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagtacgtgatgagttcgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaaagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaacaaaaaaaattagccagggcattggctcatgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggagg

SEQ ID NO: 51521 - DNA, 1914 bp, Homo sapiens
tgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagtacgtgatgagttcgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaacaaaaaggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggagg

SEQ ID NO: 51522 - DNA, 1906 bp, Homo sapiens
tgggacaaggttaaagatcgttttatccttgctgtaaaagctgatctgcctgtagctgccacagcctccagcggtggctacagttgaaaccctcacaccacgcaggaagaggtcatcatcatgtcggacgatttcttatggtttgaaggcatagctttccctactatgggtttcagatccgaaaccttaagaaaagaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaacaaaaaaaattagccagggcattggctcatgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggagg

SEQ ID NO: 51523 - DNA, 1297 bp, Homo sapiens
ggggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51524 - DNA, 1241 bp, Homo sapiens
aagagtggtatcaacgcagagtggccattacgtccggggagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51525 - DNA, 1175 bp, Homo sapiens
ggggaggagcgggcgccgggggccggctggcgcgggggctcccagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51526 - DNA, 1155 bp, Homo sapiens
gggccggctggcgcgggggctccagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51527 - DNA, 1128 bp, Homo sapiens
ggtggcgaggagttccggacctcagcgctcactgtcggagccatctgtcaccgggagggcggccgcgtaaaattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51528 - DNA, 1109 bp, Homo sapiens
aagagtggtatcaacgcagagtggccattacgtccggggagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51529 - DNA, 1240 bp, Homo sapiens
gggccggctggcgcgggggctccagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51530 - DNA, 861 bp, Homo sapiens
  misc_feature (75)..(75): n is a, c, g, or t
aaatttaccccccaaaaaagggaataagcttaaggcccgctcatttatattaatgttttattttaataaactgcnaagatcctttattttttccaggccccttcctgcccactccacatcggggcagctccagcataagggagatgacatgatgaaggggctaagagtagggcctggccagcatccactgagggcccaaccagggaacagttgctagccgctctcttccatgcagctggagcactagcaaggccttccagaggctcccagggcgacagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51531 - DNA, 1260 bp, Homo sapiens
ggggaggagcgggcgccgggggccggctggcgcgggggctcccagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51532 - DNA, 1530 bp, Homo sapiens
ggggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51533 - DNA, 1259 bp, Homo sapiens
agtcgtctctagcaggatcccctgtcagcatttccatgcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctagcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51534 - DNA, 745 bp, Homo sapiens
  misc_feature (19)..(19): n is a, c, g, or t
attcggcacgacgggcgcngggggcggctggcgcgggggctcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51535 - DNA, 593 bp, Homo sapiens
aagagtggtatcaacgcagagtggccattacgtccggggagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgctggccaggccctactcttagccccttcatcatgtcatctcccttatgctggagctgccccgatgtggagtgggcaggaaggggcctggaaaaaataaaggatcttggcagttgataaaa

SEQ ID NO: 51536 - DNA, 387 bp, Homo sapiens
tgacagtgcttgtgctaaagctaggtcttcttcctcctgacaacttggaacctggggtttggtttctgccagggacatttccagggcccgctgcagagcttcatcctcactcaggccattctgcaaagcaatcactggaggggctgtccaggacggagatcgggttgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51537 - DNA, 1845 bp, Homo sapiens
ggggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctagcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51538 - DNA, 1174 bp, Homo sapiens
  misc_feature (19)..(19): n is a, c, g, or t
attcggcacgacgggcgcngggggcggctggcgcgggggctcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51539 - DNA, 1930 bp, Homo sapiens
ggggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctagcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51540 - DNA, 1251 bp, Homo sapiens
  misc_feature (19)..(19): n is a, c, g, or t
attcggcacgacgggcgcngggggcggctggcgcgggggctcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51541 - DNA, 1654 bp, Homo sapiens
aggacatgcgagtcccgctggacctgcaatccgaccaactctttgcagaattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctagcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51542 - DNA, 1224 bp, Homo sapiens
ggggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51543 - DNA, 1667 bp, Homo sapiens
  misc_feature (19)..(19): n is a, c, g, or t
attcggcacgacgggcgcngggggcggctggcgcgggggctcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctgagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctagcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaa

SEQ ID NO: 51544 - DNA, 548 bp, Homo sapiens
aagagtggtatcaacgcagagtggccattacgtccggggagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaatcatggtccagtggatgccggtgcttgatgcagaagttgtcgacg

SEQ ID NO: 51545 - DNA, 999 bp, Homo sapiens
tactgtaactgctggccacttttccattaaaggcaaaatggcaacattgctcattgttttctcaatgtctttttatagaaattgtacttgcaccagcgcccagtgctgctccatgcttgccctcagtctgaactctgattggtgtctcgcagtggggaggagttcatgtagagggagtctgttgtgggagaaaggaaagtatgtggaggaggagagggattttaataacggcaggaggtctttaaatgggacactgccaccagtcatgaaattgacactgtgtgattttcaagggaaggggtacaatgctaaaacgttacaagccatgagtaacatttattggtgcaaatgcaagtttatactctacccatattaaaaaacaaccccttttctagtattccttatgtcagtaagtggaccctaccacccaaaagttgcctcaaaattctccttcccttccaatagggcaccagatatgtccatcctcactcctgtttttctctaaagcctcactgtcccttaatctagacctccctttgactggcaggcaagaatctaggcaagactcatgtttcttgccttctagaatgacatctcctaattgtctcttcacatcagaacaatggctactaaaactaaccctaatcattttatttctataaaaaacccagctggtttccccttagctactggttaagatagacatgagacatggcatcaagattctttaccacctctccaggcttatcaacccctccttccaaaacacacaccagcagtcagtccattccaacagattgtctttctcagctgctccaggctctttcatgtcttcctgccttggcacaaactatccctttgcctcaaatattttttctgattctacacataatggcttgctaactcatctttaaaaacccaagtcacatgctatattcagctctgaaatgccttctctggtcttcctctattcctggagcatttgtgttataacccaac

SEQ ID NO: 51546 - DNA, 363 bp, Homo sapiens
cttcaaagaattcgcaagtgggagaatgaactgttagctcagtctctctcacaccctgaagagtgtacacgtgacttgtgtattgaatcagcctgtaggtctctttaaaccgggtggtggctttaaaccacagagaggttgcttcttcccagaggatattgcctgtgctggttggtccccattgtttaagttggatgcacgctaatgtgctgttgcggcattctggacgaatgctgaggagactgtatttgttcatgacatctgatgtgagtcttgaacttgttacatttatttctctgcttttggtcacatcttggtctgatgaccaaacaaggcaactgtgcccttttctagactgatgtc

SEQ ID NO: 51547 - DNA, 986 bp, Homo sapiens
tctgaacagaactccaccctctacccctgacaccatgacccactgttgttccccttgctgtcagcctacgtgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccatctgtgtgaccagctgctgccagccttcctgctgcagcacaccctgctgtcagcccacctgctgtggccaaaccagctgtgggtccagctgtggtcagagcagctcctgtgcacctgtgtactgcagaagaacctgctaccaccccacgactgtctgcctgcctggttgcctaaaccagagctgtggctccagctgctgccagccctgctgccgcccagcctgctgtgagaccacctgctgcaggacaacttgcttccagcccacctgtgtgtacagctgctgccagccttcttgctgctgatcaagtcccaagagaaccaccatactcacacaacaaatttctgctcaactgactcatcttttgggggactaatttaatttgctgctgacagccaccatgctttcacccaaatttttatgaattctctgcatgtttaaaatcttgtgaatcagcctgagggagggcagaatacttcatcttgattctctttttccttacaccttgtggatcatgtgccagcttcgtctgttctcaatttggaatcatgatctcaactttgactcaaaagtcaagaggttcattctctgcttctaaggaatataggtttctgcaaccgaccaataatttttgcaatcacatttttgttttcaatatcctcctcatggttcttgtattcttctttattcttttcatgataactttgagttatgtccttggtaacagagattcttacctatatatttctgaataaactcttaaccatcctcatctc

SEQ ID NO: 51548 - DNA, 453 bp, Homo sapiens
agtaaagtcaacccttctagatgtgtctggttttgctccatttcaacaggattctgttcttttcaaatcagcacttctcaaactataatcacctagggatcttatttaaaatgctaattctgattctgtaggtctagggtggtgcttgagattctgttttgttttgtttttttagagacagggtctctctgtattgcccatgctggtcttatctcactgcagtctctaactcctgggctcaagcaatcctctcacctcagcttcctgagtagctgggactacaggaatgcgccactgagaccagttttcttttttttgaatttgtttgtagagatggggtttcactttatttcccaggctgagagattctgtagttctaacaggtgatggtgatactgctggtttaaggactacatttaagttaactgttatagattagtgcatttaaaatgc

SEQ ID NO: 51549 - DNA, 523 bp, Homo sapiens
ggagagtggggtgcagtcatttcatgttctaactcaaggcctgaggttggcgtatgcagtggtggggcagtataggcagctcacagtcacacagttaaatgactttccagctgccagctcatgtgatcggtagtataagcaatctgttaataaaaatggaaaattctgaactaattaatttgaaaaggaatgcccataatctcagtcagagaaacatttattttggcacggcacaattctattctcttgtgactatgtcagtatggtaagtgtggcacatttgattccaattaaatcttaaatgactatagagcttaattccagttaaataccctagtgaagctgtagttttgtgagctgtagctatagaaaggggcttctgtgaattattttccttttactttgacatgattaggataattttgcacattagctagaaactgtttgcataaaataaggatataaactccaacctgattttataaataacattcagagcagagtttatgagcatggtgggctg

SEQ ID NO: 51550 - DNA, 630 bp, Homo sapiens
caggctgtgcttctggatttcagctgcagcaggtccgtggctgggtcttagaatttgcatttctaacaaaggctcagttgctactgctgatgctggaccaaggactacactttgagaagtgtaagtctgctctgggcagtcttagaagccaccattgatttctatttgagtttacccaggtgtcattagtacacacagctcctaagacccctgtgatctctggaatatggaattttcagtccccactccccgacctcaccaacatccagagaggggagagaggcttgagacttggctaatcactaacggcggatgattcaatcaatcattctgatgtcattcaacctctttaatgacggagttcaggagagattggtagttggtaaacacatccacatggtggggggtgcacatcccaactccaaggggtcaaacgctcctgtggctcgggacccttcgagatctcaagacctatgtaactctttgtcacttgttaaccttgtagtaaaccctgatcgtcaatcaagtggcttcttgagttttatgagccattttagcagattagcaaacctgaaagggaaagcctgtgggaacccctgactttgtaggcaagctgtgggtacccatgag

SEQ ID NO: 51551 - DNA, 333 bp, Homo sapiens
agcaatactaaacataaatgtaaattgggctaaatgctcccaattaaaagacacagagtggcaagctagataaggaaccaagagccattggtatgctgtcttcaagagactcatctcacatgcaatgacacacatagactcaaaataatgagatggaggaacatttaccaagcaaatagaaaacaacaaaaaatatttctaatagatttctgcttttaataatgaaatatgtcaaactcctataaaaactatatgtaggaaatataaaagtttatatataattcatgtaatggttaatagtaactgaatagctagtattgaataaccaagctt

SEQ ID NO: 51552 - DNA, 268 bp, Homo sapiens
tcctgtacccaggccccaggcaagttgttgacatttgcctgtcttgccttagctatctcagctctcacacaggatacccacatgcaggcttttttgtctctctgaagtattttaaattgcagacattatatcatttcacaataaattttcagcgtgtatctgaaggtaaagttcatctctaacagcaaagttaaaaacaatgtaagtactttactgttatcacaccaacaaaattaatataattccttcatatcaccttatatctagt

SEQ ID NO: 51553 - DNA, 491 bp, Homo sapiens
atagatagttgaaatagacctataggaacacaactactgaaattaaaaggtattcagttgcttgtttctgttcatgagtactagttttattctacagatagtacctacagtttgcagcaaataagccaaaacaacaagaaaatatcttgtttgtatgttttagttttataaattagtcttctctgcatatctaaatatatatttcctaatgaggtttaatattcaaggagataaatatgagaaaatgctttgaaaccaattataggaataatcttacataatctgcaaatgctgatcaaaatacatcatttctacaatgtcaatactgggaaaatatagctttattaggttgaaaataattattttgacttttatgataatggttagatttgattatatgtacatagggataaatacaacattgaaaacactaagccacataaatttaaaacatcgtgtaattcgaacagcttcttactagtggtttattt

SEQ ID NO: 51554 - DNA, 545 bp, Homo sapiens
atagatagttgaaatagacctataggaacacaactactgaaattaaaaggtattcagttgcttgtttctgttcatgagtactagttttattctacagatagtacctacagtttgcagcaaataagccaaaacaacaagaaaatatcttgtttggttatactagaattcaatggctgttaatgctctattacacacttaaattagttttatgttttagttttataaattagtcttctctgcatatctaaatatatatttcctaatgaggtttaatattcaaggagataaatatgagaaaatgctttgaaaccaattataggaataatcttacataatctgcaaatgctgatcaaaatacatcatttctacaatgtcaatactgggaaaatatagctttattaggttgaaaataattattttgacttttatgataatggttagatttgattatatgtacatagggataaatacaacattgaaaacactaagccacataaatttaaaacatcgtgtaattcgaacagcttcttactagtggtttattt

SEQ ID NO: 51555 - DNA, 473 bp, Homo sapiens
tatcaattctgatttttttttaaaaagcaatgcatgagataatagcaattcatattgctactatcaatgtactaacaaaagtggctttgttaggcatttggaaataatttatttactgaagaactattacttttattgttcttaccgactcgaaagagtccataatacctgcttaggtacggaaaattagacctggtgtggtgactcacatctgtagtcccagcacattttggggccaaggtgggaggatcacttgagcccaggagttccagacaagcctgggaaacatacggatactgcatctctacaaaaaatttacaggaaaaaattatctggggtgtggtggtgtataccaccaccactacttgggaggctgaggtgggaggattgcttgagtctgggagatcaaggctgcagtaagctgtgatggcatcactgcactctagcctgggtgagagggagaccctgtctcc

SEQ ID NO: 51556 - DNA, 333 bp, Homo sapiens
ctattcttaaagcctgcaaacatagttgatctcttttaataaatctgaagagttggattatgtaatagtaagacttcctgagaactttgcacttaaatatttatatttgtgtactgagtaatcattaatacatttattagataagtaatggaaaataacttacctgaaaagcactgtgtttttactctgcattttttaatgagcattggagaatgtacaaatactttattgcttttttccatataaaatacatgattatttctgtacatgaatacgtatactattgaactgctgaagtaaattaaataatgagatgaataataaagtcagaag

SEQ ID NO: 51557 - DNA, 255 bp, Homo sapiens
cagaaatggaagacccaaaggacagagctgtagagtcaaggacacatgaattttgttatgaggagagggcagagaaggaggctcaggatgtttaatgaatttagggagcaagggtgatttataaagaaatggattggggagattaatttggaggggaaggaaagagaaacacagacaaactagaaacattaggttgttgtaagatgggagtattgggagattaatatagaggctgcttttgaaaatcatataatt

SEQ ID NO: 51558 - DNA, 588 bp, Homo sapiens
gaaggctcagtataaatagcagccaccgctccctggcaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatttgt

SEQ ID NO: 51559 - DNA, 846 bp, Homo sapiens
gaaggctcagtataaatagcagccaccgctccctggcaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagcggggagagggtacacaatgggtatctaataaatacttaagaggtggaatttgtggcaaacaacacgacaccgcacagcacccacacacacacaccaaaacggacacaacacaagcgaacacaggcaggacgcgaccgacaagacgagcaaaacaaacagggagaaagcaaaaaagaagcacaaagaacaagacagagggcgggcgagacaccacgcgcacagacagaggcgcacacacacaagccaggggcggggggggcgcgcgccgcacagaaagaagagcagagaaggcgaagcgcgggccggcaagacgcagggacggaggcacaagggggg

SEQ ID NO: 51560 - DNA, 747 bp, Homo sapiens
gaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaattgtaagaggcgaacaaaaacaaacaaaaacac

SEQ ID NO: 51561 - DNA, 985 bp, Homo sapiens
gaaggctcagtataaatagcagccaccgctccctggcaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcaggctgaagtgccatggcatgatcatggctcactgcaacctcgacctcccggggctcaagagatcctcccacttcagcctcttgaataactgggactgcagatgtgcgccatgacacttgcctaatttttatattttttgtagagatggggtttcgccgtgtcacccaggctggtcttgaactcctgggctcaagtgatctgcctgcctcagcctcccaaagtgctgggattacaggcatgagtcactgagcccagcctactgttatatttattttgtgtcggtttgaggctgcccagattcacattgtttctggggtcgtctgtgagggtgtttccagaggagattaacatttgaattggacttaataaagtagattgctattctcaatgcaactgggcatcacccaatctgttgaaggcttgaatagaacaaaaatagaggaaggacagatttgcctcccttttcccctgcctcactgcttgagttggacatctcctctcatcttctcttgccctcaaattggatttacatgatcagttgctctggttctcaggcctttgaactcagactgaattacactttcctgagtttctagcttgcagagggcagatcgtgggacttctcagccccaattatcttgtgagccaattccttacaataaataaatacatacataca

SEQ ID NO: 51562 - DNA, 789 bp, Homo sapiens
gaaggctcagtataaatagcagccaccgctccctggcaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagtttattttcagctgaactgtagagagtgaaggaagaagccttttttcttcactcctacatgacccaggcattgatccaggcaatgaagattcagtgtaaataaccaccactaacaagaccatggcctttggaacctgtgctaagaggcatggatgagctccctcagcatgtggatggagactgaagagaggtctgaaggctcagtgtggtgtctccattctctaagaagtttggaggagaagctggatacagcaaaacagactgagaaggagcagctgttgggaaaggaggaaaactaggaaagcatggtgttccagaatccctgatggagatattgattagtagtatcagattctgcttagcagttgaggagttcacctttggcttaagcaacatggagtcattgactatctcgtgaaggtggttgcaggagaaggtctggagaactaaatggagcagtgataagagagaatgggagatgg

SEQ ID NO: 51563 - DNA, 792 bp, Homo sapiens
gaaggctcagtataaatagcagccaccgctccctggcaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtatcggaggactcgaagtccaacgagaaagctgaggaatggggccggagtggcaaagaacccggacgcttcagaactgaccggctgcctaagaaatacttgagcttcctggttcctctggtctcagggaacttgggcttgtgagccacacacttttcccccccagaacagggaccacagggtcacttgc

SEQ ID NO: 51564 - DNA, 539 bp, Homo sapiens
gaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagagaagatgactgaggaatacaaccacaactggatggactttttcaaaagatgacacctgcttatttgcctcattcaaatttcaag

SEQ ID NO: 51565 - DNA, 442 bp, Homo sapiens
tcattcccctctaaggtggtgttggagtctttatgttctcctgatgtcccttctgcctttcctttcctttccaggggctcgggacatgtggagagcctactctgacatgagagaagccaattacatcggctcagacaaatacttccatgctcgggggaactatgatgctgccaaaaggggacctgggggtgcctgggccgcagaagtgatcaggtaactggagctcctgggacgttagggctgggtgagcagagcttgcctgccttggacagtcaggagggagacgagctccttgtagagaagttagaggctgcggcccctcctcttcttgccctctctctgcctctgtgctcagtgtgagggtctgagtggatggtaggagtgagtgattcctccccctccccctctgggtgctgttcatccagcctaggggtgcccagcc

SEQ ID NO: 51566 - DNA, 3652 bp, Homo sapiens
  misc_feature (344)..(344): n is a, c, g, or t
  misc_feature (1124)..(1124): n is a, c, g, or t
gcgatcgtggccgctgccgccgccagagccggccggagtcggcccggagccgcgtccacgcggagcgggcgggtgggagctggcggctgggcccctgcggcgcccccgcggcctgccccgcgtccgctccgggccgccgagccgcagccgccgagatgggggccgccccgggccgcgcccccgccgggtcccgcccgccgcgctgccgctgagcgcatgggccgggccgcgccgcgccgctccgggagccgggcccggggtcccgccaccaccgcgcgcgggacagattgattcactttggagctgtaagtactgatgtattagggtgcagcgctcattgttcnttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggangaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcatcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctgaaaaaaaaaaaacaaaaaag

SEQ ID NO: 51567 - DNA, 692 bp, Homo sapiens
ataaggaattttgggccctcaagcgccaagatttgggcacaaggtgaaatcttagaaaatgtatacacttctgagcgtttccattcacctgatccttgatgtaaaatgcagaccttcagctctcctcagaccacaggagacccctcggtacactcactctttcacccgctacccgggtgagctgtgccctgaagcctggagatgccaccgtgagggtggacgcagggtgccgctggtggtgcccatctgggaaaccgtgcgccgggcactccattgagatggcaggcagaccttacatagctcgttgagcagctgggattcatggcggggaccaggtgtggtcgctgcagatggtggagctccccatgaaggggtttgtgtggaaatgtctcacacacagacgtcgatttgttttatcctcagtaaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctg

SEQ ID NO: 51568 - DNA, 3602 bp, Homo sapiens
  misc_feature (344)..(344): n is a, c, g, or t
  misc_feature (1124)..(1124): n is a, c, g, or t
gcgatcgtggccgctgccgccgccagagccggccggagtcggcccggagccgcgtccacgcggagcgggcgggtgggagctggcggctgggcccctgcggcgcccccgcggcctgccccgcgtccgctccgggccgccgagccgcagccgccgagatgggggccgccccgggccgcgcccccgccgggtcccgcccgccgcgctgccgctgagcgcatgggccgggccgcgccgcgccgctccgggagccgggcccggggtcccgccaccaccgcgcgcgggacagattgattcactttggagctgtaagtactgatgtattagggtgcagcgctcattgttcnttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggangaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcatcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacaggcctccttcccatctgcggtgctgcctgctcactgccctcctcacctccgtcctgcagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctgaaaaaaaaaaaacaaaaaag

SEQ ID NO: 51569 - DNA, 2877 bp, Homo sapiens
  misc_feature (344)..(344): n is a, c, g, or t
  misc_feature (1124)..(1124): n is a, c, g, or t
gcgatcgtggccgctgccgccgccagagccggccggagtcggcccggagccgcgtccacgcggagcgggcgggtgggagctggcggctgggcccctgcggcgcccccgcggcctgccccgcgtccgctccgggccgccgagccgcagccgccgagatgggggccgccccgggccgcgcccccgccgggtcccgcccgccgcgctgccgctgagcgcatgggccgggccgcgccgcgccgctccgggagccgggcccggggtcccgccaccaccgcgcgcgggacagattgattcactttggagctgtaagtactgatgtattagggtgcagcgctcattgttcnttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggangaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcatcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctg

SEQ ID NO: 51570 - DNA, 2521 bp, Homo sapiens
  misc_feature (344)..(344): n is a, c, g, or t
  misc_feature (1124)..(1124): n is a, c, g, or t
gcgatcgtggccgctgccgccgccagagccggccggagtcggcccggagccgcgtccacgcggagcgggcgggtgggagctggcggctgggcccctgcggcgcccccgcggcctgccccgcgtccgctccgggccgccgagccgcagccgccgagatgggggccgccccgggccgcgcccccgccgggtcccgcccgccgcgctgccgctgagcgcatgggccgggccgcgccgcgccgctccgggagccgggcccggggtcccgccaccaccgcgcgcgggacagattgattcactttggagctgtaagtactgatgtattagggtgcagcgctcattgttcnttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggangaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcatcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctgatgatagctgcggggatccttagagtgactgtaaatgc

SEQ ID NO: 51571 - DNA, 352 bp, Homo sapiens
aagatcacgccattgcactccagcctgggtgacagagcaagagtttgtctcaaaaaaataaaataaaatacaacagagatagcacacgctctttcccttcacaaagaaatgtttagcctgtgacctttcaacccccgtgcctcacagtcctgtccctcgcagcgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggtgagtgggccgcgtcggtgtcgcgctccgcgtcggtgtcgtgctgttttct

SEQ ID NO: 51572 - DNA, 3524 bp, Homo sapiens
  misc_feature (344)..(344): n is a, c, g, or t
  misc_feature (1124)..(1124): n is a, c, g, or t
gcgatcgtggccgctgccgccgccagagccggccggagtcggcccggagccgcgtccacgcggagcgggcgggtgggagctggcggctgggcccctgcggcgcccccgcggcctgccccgcgtccgctccgggccgccgagccgcagccgccgagatgggggccgccccgggccgcgcccccgccgggtcccgcccgccgcgctgccgctgagcgcatgggccgggccgcgccgcgccgctccgggagccgggcccggggtcccgccaccaccgcgcgcgggacagattgattcactttggagctgtaagtactgatgtattagggtgcagcgctcattgttcnttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggangaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcatcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctg

SEQ ID NO: 51573 - DNA, 2608 bp, Homo sapiens
  misc_feature (208)..(208): n is a, c, g, or t
cttgcatgtaccgggaccggggaatgtgaggtaggggcacccgcccattgacctgcacgctctcctgcatctccctgcggtgctgcttacggatcctgtatggggggatcccatccagagctctgggtcagggacagggaagggcatatctggatacctgccgaccttaaatgaagatgaggaatggaagtgtgaccaggacatggangaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcatcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctg

SEQ ID NO: 51574 - DNA, 1652 bp, Homo sapiens
atgataggcaaaaatgggaaaataacttgaggccaggagtataagggcagcctgggcaaaatagtgagacaccgtctttacaaaaactttaagtgtcagacaggcaacttggtgggcattttttttttgagatggagtcactctgtcacctaggctggattgcaatggtgcaatcttttcttactgcaaccttcgcctcccgagttcaagtgattctcctgcctcagcctcctgagtacctgggattacaggtgcacaccaccacgcttggctaatttttgtatttttagtagagacgggatttcaccatgttggtcaggctggtctcgagctcctgacctcgtgatcgaccttccttggcctcccaaagtgctgggattacaggcatgagccactgcacccagccttggcgggcatctttcaccaaagctactcaggaagccaaggtgtgaggacccctgcagcacaggagttcaaggcttcagtgagctatgggtgcaccactacacatcagcctgggtgagagagtgagaccatgtctcagaaaggaagaaaaattatccacttgtaggttgtctctaattacttccctgacccgcactcttcatttgtccaagtgctgcagctgtgctctcaacaatttttacaacttctgggaaagatgcccatggcccttgacgatagtgatgcatgtgcatcccacacacaggggtttcctgttcttttgttatttccctctctctttcaacaagtgttgcttcttacggattgaatttctccactgatagatcctcaagtcttgttttcacagatattaatttctctatcactaagatcacccattagtaagaattactaataaagataaaaaataaaaagtaaagaaagtacagaaaaaaagaattttaaataatcttcctagtacctgggaaacagttaggcagagttcaggtatggatctaagatggcactgtcagtaagaggcagaatcaggactggagtccaggcagcctggctcctgaatcctagctcctaactatgagaccctcatgtctttaggaatatggagttctgactgtgatagggtgaaagagggaagtcctcacagtttgcctgttgatctctaattttctacatcatggtaatctgtcacaaaaggggaggccacacctggcccagcccctttcacccactctcaatcccctagcaggtgccacacagaaggcgtgtcctcgtccattggttcttgcatgacaatcagagggacacggatcctccctttcatcaatgacccagagctgcgggtggaattctacactgggatgaatgagaactcagacatcgccttccatttctgagtgcactttggccattgtttggtcattgacagccatgtgtgtggggcctggaagtgtgaggggagatgccacaatgtgttcttcaaggacggcaaacaatttgatctgagcatcttggtgctagacaatgaataccagaagcttgctgggaggagcatggaatctggaatgatgccagagggcaaagctgaaaggggtcatttaagtgctgcaactcagagattcactcagaagactggacacaattccgaaggtcgcccagaaggagaggacaatgtcatttctaactgtgag

SEQ ID NO: 51575 - DNA, 789 bp, Homo sapiens
  misc_feature (584)..(584): n is a, c, g, or t
actgtagccttgtagtatactttgaagtcaggtagcatgatgcctccagctttgttcctttggcttaggaatgacttggtaatgcgggctcttttttggttccatatgaactttaaagtagttttttccaattctgtgaagaaagtcattggtagcttgatggggatggcatttaatctataaattaccttgggcagtatggccattttcatatttattcttcctatccatgagcattgaatgttcttccattgtttggtcattgacagccatgtgtgtggggcctggaagtgtgaggggagatgccacaatgtgttcttcaaggacggcaaacaatttgatctgagcatcttggtgctagacaatgaataccaggtaataataaatggccaacaccatacatctttgcccatccacttccaccatgttctatgaagattttgcaagtgtgggaagatgtctccctgacctcaatgtctgtctgcaatttatggagatgaccacacccctcattgttgaggaatccctctttccatgtgaccataggatccccagagcctgctaacagcatgatctctcctcanccttttccctacacttggtcattaaaacatcaccaaaaaagagccacgcacacacgcgaaacacaaccacatgtggcggccccacatggggacccgcagagaaaccctgtcagagaaccaaggagaaggcgccccgggccccaaagcgagacgcgcgacagagtggcaaaacagggcaccaagggaaaacccgcgcacagacacg

SEQ ID NO: 51576 - DNA, 395 bp, Homo sapiens
cccaacactccgtgtgctttgccctcagcaatgacccagagctgcgggtggaattctacactgggatgaatgagaactcagacatcgccttccatttctgagtgcactttggccattgtttggtcattgacagccatgtgtgtggggcctggaagtgtgaggggagatgccacaatgtgttcttcaaggacggcaaacaatttgatctgagcatcttggtgctagacaatgaataccagaagcttgctgggaggagcatggaatctggaatgatgccagagggcaaagctgaaaggggtcatttaagtgctgcaactcagagattcactcagaagactggacacaattccgaaggtcgcccagaaggagaggacaatgtcatttctaactgtgag

SEQ ID NO: 51577 - DNA, 1996 bp, Homo sapiens
  misc_feature (1791)..(1791): n is a, c, g, or t
atgataggcaaaaatgggaaaataacttgaggccaggagtataagggcagcctgggcaaaatagtgagacaccgtctttacaaaaactttaagtgtcagacaggcaacttggtgggcattttttttttgagatggagtcactctgtcacctaggctggattgcaatggtgcaatcttttcttactgcaaccttcgcctcccgagttcaagtgattctcctgcctcagcctcctgagtacctgggattacaggtgcacaccaccacgcttggctaatttttgtatttttagtagagacgggatttcaccatgttggtcaggctggtctcgagctcctgacctcgtgatcgaccttccttggcctcccaaagtgctgggattacaggcatgagccactgcacccagccttggcgggcatctttcaccaaagctactcaggaagccaaggtgtgaggacccctgcagcacaggagttcaaggcttcagtgagctatgggtgcaccactacacatcagcctgggtgagagagtgagaccatgtctcagaaaggaagaaaaattatccacttgtaggttgtctctaattacttccctgacccgcactcttcatttgtccaagtgctgcagctgtgctctcaacaatttttacaacttctgggaaagatgcccatggcccttgacgatagtgatgcatgtgcatcccacacacaggggtttcctgttcttttgttatttccctctctctttcaacaagtgttgcttcttacggattgaatttctccactgatagatcctcaagtcttgttttcacagatattaatttctctatcactaagatcacccattagtaagaattactaataaagataaaaaataaaaagtaaagaaagtacagaaaaaaagaattttaaataatcttcctagtacctgggaaacagttaggcagagttcaggtatggatctaagatggcactgtcagtaagaggcagaatcaggactggagtccaggcagcctggctcctgaatcctagctcctaactatgagaccctcatgtctttaggaatatggagttctgactgtgatagggtgaaagagggaagtcctcacagtttgcctgttgatctctaattttctacatcatggtaatctgtcacaaaaggggaggccacacctggcccagcccctttcacccactctcaatcccctagcaggtgccacacagaaggcgtgtcctcgtccattggttcttgcatgacaatcagagggacacggatcctccctttcatcaatgacccagagctgcgggtggaattctacactgggatgaatgagaactcagacatcgccttccatttctgagtgcactttggccattgtttggtcattgacagccatgtgtgtggggcctggaagtgtgaggggagatgccacaatgtgttcttcaaggacggcaaacaatttgatctgagcatcttggtgctagacaatgaataccagagcaccctctggttgcaccgctatcctcagctcgtttccaaaatctgaccgtgatcagtatcagctcatctggcatttcccccaaggtaataataaatggccaacaccatacatctttgcccatccacttccaccatgttctatgaagattttgcaagtgtgggaagatgtctccctgacctcaatgtctgtctgcaatttatggagatgaccacacccctcattgttgaggaatccctctttccatgtgaccataggatccccagagcctgctaacagcatgatctctcctcanccttttccctacacttggtcattaaaacatcaccaaaaaagagccacgcacacacgcgaaacacaaccacatgtggcggccccacatggggacccgcagagaaaccctgtcagagaaccaaggagaaggcgccccgggccccaaagcgagacgcgcgacagagtggcaaaacagggcaccaagggaaaacccgcgcacagacacg

SEQ ID NO: 51578 - DNA, 1910 bp, Homo sapiens
  misc_feature (1705)..(1705): n is a, c, g, or t
atgataggcaaaaatgggaaaataacttgaggccaggagtataagggcagcctgggcaaaatagtgagacaccgtctttacaaaaactttaagtgtcagacaggcaacttggtgggcattttttttttgagatggagtcactctgtcacctaggctggattgcaatggtgcaatcttttcttactgcaaccttcgcctcccgagttcaagtgattctcctgcctcagcctcctgagtacctgggattacaggtgcacaccaccacgcttggctaatttttgtatttttagtagagacgggatttcaccatgttggtcaggctggtctcgagctcctgacctcgtgatcgaccttccttggcctcccaaagtgctgggattacaggcatgagccactgcacccagccttggcgggcatctttcaccaaagctactcaggaagccaaggtgtgaggacccctgcagcacaggagttcaaggcttcagtgagctatgggtgcaccactacacatcagcctgggtgagagagtgagaccatgtctcagaaaggaagaaaaattatccacttgtaggttgtctctaattacttccctgacccgcactcttcatttgtccaagtgctgcagctgtgctctcaacaatttttacaacttctgggaaagatgcccatggcccttgacgatagtgatgcatgtgcatcccacacacaggggtttcctgttcttttgttatttccctctctctttcaacaagtgttgcttcttacggattgaatttctccactgatagatcctcaagtcttgttttcacagatattaatttctctatcactaagatcacccattagtaagaattactaataaagataaaaaataaaaagtaaagaaagtacagaaaaaaagaattttaaataatcttcctagtacctgggaaacagttaggcagagttcaggtatggatctaagatggcactgtcagtaagaggcagaatcaggactggagtccaggcagcctggctcctgaatcctagctcctaactatgagaccctcatgtctttaggaatatggagttctgactgtgatagggtgaaagagggaagtcctcacagtttgcctgttgatctctaattttctacatcatggtaatctgtcacaaaaggggaggccacacctggcccagcccctttcacccactctcaatcccctagcaggtgccacacagaaggcgtgtcctcgtccattggttcttgcatgacaatcagagggacacggatcctccctttcatcaatgacccagagctgcgggtggaattctacactgggatgaatgagaactcagacatcgccttccatttctgagtgcactttggccattgtttggtcattgacagccatgtgtgtggggcctggaagtgtgaggggagatgccacaatgtgttcttcaaggacggcaaacaatttgatctgagcatcttggtgctagacaatgaataccaggtaataataaatggccaacaccatacatctttgcccatccacttccaccatgttctatgaagattttgcaagtgtgggaagatgtctccctgacctcaatgtctgtctgcaatttatggagatgaccacacccctcattgttgaggaatccctctttccatgtgaccataggatccccagagcctgctaacagcatgatctctcctcanccttttccctacacttggtcattaaaacatcaccaaaaaagagccacgcacacacgcgaaacacaaccacatgtggcggccccacatggggacccgcagagaaaccctgtcagagaaccaaggagaaggcgccccgggccccaaagcgagacgcgcgacagagtggcaaaacagggcaccaagggaaaacccgcgcacagacacg

SEQ ID NO: 51579 - DNA, 1606 bp, Homo sapiens
  misc_feature (3)..(3): n is a, c, g, or t
  misc_feature (5)..(7): n is a, c, g, or t
atncnnnaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggatacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtat

SEQ ID NO: 51580 - DNA, 1434 bp, Homo sapiens
ggatccccgtgatgttatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggatacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtat

SEQ ID NO: 51581 - DNA, 787 bp, Homo sapiens
tctcaaaggaggtataaatccccctgacttgtaattccaccccagctccagcctcacctctccttgacttaccttggcttatggttgggtgtcgggcggctgttatacataaagctatgggagtgaatggtgtgtcccagttcccaaccacggtgctactagcaaagggtcctctggcaggagtgaacagtggaagggtagggatagttgacagtcaggttatggtctgtgtccttaagaggttcacagtctagttgaagacacaaaacattaaaatagaacacgatgtacaatctgatgggtgctctagaatgccagataaagactgtgaacccaagagacaaaagagacagctctacttgggaaatgagatcatggaagacttcccagaagaggcagccttttgaccagtattgttttgttttgttttgttttgttttgttttgttcattatttttatttgttacatgtcttgcaagcaaatttaattttctaaagaattttttttctgatcattttaacatgcgtttttgaaccatgaaagtgtaaaaaattattaaagaaaaccagaaattcagatcagagaattacaaagaagaaaataactcaccagtaaactagtattcctacaactcaacaatattcactgtacatatattttagttcatctgcttctagtctttttcacacagtgtgcacccaaatatattgtgtcagatttatgtgtatagggctgggcgttgtggctcacacctgtaatcccagcactttgggaggccaaggcagg

SEQ ID NO: 51582 - DNA, 434 bp, Homo sapiens
atcatttccattaatgaagatacctgggtgggggcagattgtataatttatcgaagataagctgtgtttctctactgggctggcaaaaatattttttctggaccttaaaggtagaaaggttctggtgaagaagctatttaaaagtatccttagtattattttggggaaggagatataactttgccctatttattgaggtttttggaggacttttacaggcagtagagatgtttccatagctggatttctgagccattacgttgtggttgggaacctttcttttgtagtatactgtagaattttgggatgtgacactgtaaatgggatagatgaggaagatgaccagttcctgagaactggaaggaatcccagcttgacttgagaacttctttaaaacaaaatgaaacaaaacaaaacaaaaaaactgctaaaaa

SEQ ID NO: 51583 - DNA, 419 bp, Homo sapiens
aaaaaaaaaagttactgcctagaccaatgttatggggcttttactctacttttgtgtattagtttcattgcagtttcaagcattacatgtaagtttctaatttattttgaattgatttttacatgtggtgtcaaatgagggtctcattgctttgcatgtggctgtaaagtttctcaacaccatttattgaagatactgtcctttctctgagaaattgtcacctatatttaaaattagatagttgtaaatacatggatatatttctggtttctttgggttcatttttattccaatatactgctttggtcactatagctttgtagtatatttcaaagtaaggttgtgtgataccttcaacctttcttttttgcttgattgctctgggtatttggggtcttttgtggtgccatattaatttt

SEQ ID NO: 51584 - DNA, 402 bp, Homo sapiens
ctgcctcacctaatttttagggagtgtgtaagagaaacagccagtcagaagctacacagccaagtccaggcatcaggctttcctcatctcttccagtgatgacccaccagcagtctgcaatgggacgtgctgggaagcaaacccaaacagcagctgcttccttgtgtggaggatttcctaaataccaggccttgcgtgcacattatctcgtctcatcctcacaacagaacagctcctcattttacacacaaagacactgaagccctgggaagttgtgacttgcttaaggccacactgtctgtttagaggcagagcagaggccaaatggtggtggctcagctccaaagcttgtgccatttctctggcatcacaccaactctccttgataatagggacagtagg

SEQ ID NO: 51585 - DNA, 378 bp, Homo sapiens
aaatactattattactcaccaaacacaaacatcagttactatcccaaagtgcgttgtccaatacagtagcaactagctctatgtggctattttgatttaaattaatcaaaattaaataaaacagaaaactcagttctttagttatacacaccacatttcaagcactcaatagcctcatgtgactatcatatgggatagcccagatataagacatttctatcactgcagaaagttctactggacagtgctgatctgggctatgcttatatccagcatacccatcttcaactacacatccagctggacatgaaaaaatttaagtaaaaaatacaatgacaagtatgacaagatagctagtgccataatacttgagaaata

SEQ ID NO: 51586 - DNA, 386 bp, Homo sapiens
tgagaattgaaaataattcattttggttgactggaaaatgatcagatggaatttaacagagatatgtagagtcctagacttaaaaggtcaggtaggatttgagagacctgacttgacagcattttatgtgaaaattcctgagtgttttcagcaggcccagcttaactggccacaccagtgatgcagctccttacacaagtgcatgcacaggcacacacaacacatatgcacactactaatgcattcctctgctctcattgaagctaagggcccagactgttggagggcagtggcctcactgccctggtgagaccacacccgtggtgtcacactcagttctgggcgcggtgttctgagacggtgtgcacaaatgggaggggatgggc

SEQ ID NO: 51587 - DNA, 652 bp, Homo sapiens
tgcttttgtatcctgcaactttgctgaattttaacttaattttaaaaactatttttttctgacgatacaatgagtaaaatgaaaaaaaatagaaaatcataactaattagataaaaattactcacaattccaccactattagccaactatatttgtgttgtctcattctctcttttttcctccttctcataattagcctcacgctattaatatttttaatcctattttgccacttaagagtatataatgaacttcaattattttcataaagacatatgttcataaaagtttcagcagatacatgtatatagttgagtttggccactgcctgtttccatgtctcctcagctcaaactctttgaaaccccagctttgaacctatcaatatgtaaaggcatcatttacaagttgtaaggtttttaaatagcattttaagtccctttggttggtaaactcaagaagcaaacatcatttgaagacaactttgggacgtggatgtatagtgatattgcgattttactaaatattgcttgagaatgagagcagttcattccttttcatggacttctcttcatccaggaaagggattaaggatcacaatttctgatcttaaaaggaccaatcaaacaaataataaaagaaattgtgtgta

SEQ ID NO: 51588 - DNA, 233 bp, Homo sapiens
gtgatatggtttggctctgtgtccccacccaaattacatgtgaaattctagttcccactgttggggaaggggcctggtgggaggtgattgaatcatggaggctgacttctctcttgctgttctcatcatatggttctcctgagatctagttgtttgaaagtgtgtagcacctccaccttctttctctctctctctctctcctgccagcaatgtgaatatatgcttgcttcccc

SEQ ID NO: 51589 - DNA, 325 bp, Homo sapiens
ctcacagcagctttgagctcctgggctcaagtgatcctcccacctcagccccccagatagctggaatacaggcacatgccactttgctgaacttctccctacgtttctatgtttgaaaagctgtataatacaaggttaagcaaaaaacaaaaaacacgctatgctcacactggactttgagagctcatatggtattttatgctgagcctttcttcccactaacgcccttagattgaatcttggctgcagtgggagatggaggttgcagtgaactgcgatcgcgctactgcaccccagcctgggcaacaaagctagaccttgcctc

SEQ ID NO: 51590 - DNA, 267 bp, Homo sapiens
cagctattacacttgatagattctcctaacctcttaaaatggttagaggagaagaaaaagaaaatggagggaatggctttgaatttgaagtcttatgatgtggaacttttagctttaactgtccatttcttttctttgcatcttttatcgttatcccagcttttattcccttttagattcttagtttttaacattgtgttacccagaatccccacaaattattgtttggccttaacccgcaactcgaatttgccattaaactataaa

SEQ ID NO: 51591 - DNA, 348 bp, Homo sapiens
gaaaaccctttaatgatcacagaaaaccaggttcctaaccagatgataaattttgataaatcaatgatatccagatcacgactttaaattcccattggtccactggacaatcaacattatcacacacatgcctgctcactttggctgacccagctgactaagtacaggtccgtattgccaaattaaacatggaggagaacgctgacttttagacagcttgcctaaatttagtgttaatttgaaccagcttttgagcaagtacaattatgattggaacttacttcagccaaacaaaattttctagctggtcatgagagattgtttgagcaatatagaggtgagattgcg

SEQ ID NO: 51592 - DNA, 406 bp, Homo sapiens
  misc_feature (102)..(102): n is a, c, g, or t
  misc_feature (128)..(128): n is a, c, g, or t
agccgggccgggcagctagcagggcgcttcgggtgctgtgctggtgatatggggtgaaagtcccacgaagacacatatatggctgcttttaattctactttnaggatcagggaagacaatatcaagtnaaaggtcaactatcgctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtgagccaagcactgt

SEQ ID NO: 51593 - DNA, 3614 bp, Homo sapiens
  misc_feature (129)..(129): n is a, c, g, or t
tttgggatggctgggcacgcaccccaagaatggagcccatggaggcgctgaacacggcgcagggcgcgcgacttcatctacagcctgcactccacggagaggagctgcctgctcaaagagctgcaccgnttcgagtctattgccattgcccaagaaaaattggaagctccaccacccaccccaggacagctgagatatgtattcatccacaatgcgatacctttcatagggtttggctttttggataatgcaattatgattgttgctggaacccatattgaaatgtctattggaattattttgggaatttcaactatggcagctgctgctttgggaaatcttgtgtcagatctagctggacttggacttgcaggctacgttgaagcattggcttccaggttaggcctgtcaattcctgatctcacaccaaagcaagttgacatgtggcaaacacgtcttagtacacatttgggcaaagctgttggggtgactattggctgcattctaggaatgtttcctttaattttctttggaggaggtgaagaagatgaaaaactggaaacgaaaagttaatcctcttagaatacctataaaaagatgtaaactaatgtacctcagtaattaaatatgctgtcacaacatttaggaattaagacagtaacagtatagatatgggatcaaataatttagcatgtattatggaaaacactaacttattgtggcttgatcttcttaggacatcttttttaaaaagctgtttagtatcattttgtgtatattgttgaaatgctttttcatcaatagcagtcaacattttatcctttctttttatattcataatgttatttaagtgtcattgatgtactgtattgacttggggtttgcttatttgttacttaacatgtgtacatgcatgaaagcatttttcgttgttccctgatagttacatttcaaccttgggatttttccaaattacttaagatgtttaatgtcagttaaagatttttttaccctctttttgggaacatcaattttgtactgttatgcagtaaacatttataataatataatttcagtcatttcttaactgtcacatctattgaaaatggatatagatacaggttttaagtattttaagtatatattacttattttaattttctgactttactattttaagggccagagggttaatcacaaagagcaattatgtggtctccctgctacatgaaaccgtgtatactaacaagcgtacaatttttagttgattttttttaaccttttagtttcccagttttgaataattacatggtggattctgacttttgaggggaagcaaatgattattttagagtctttgaaatggggattgtggaattagattgaactaagggatttaacatgatgcttggaaattaagagactaaagctttttttaaaaaaaggtggaaaataggaactgtcaagaaggtttatggtataaatgatgaagttgaagtgatgtttgaaagattaatgagatacaatttatattatttggtaaggtttttttttttccctccaaagatgtcatcttctcatctgaatggaataagtctgaataccccatattcatactcctaatctcattatatcttatttagtgaattttatttatgaataatttctgttgaagtgaaaactagatatttaatattttgcttttttgctacatagtctactcaaaaattacatgaggagaaatcctttttccctttgtttttcttttttcttcttttgtggtatttaaagcatattttaggttgaagttacttatttctagtcttgtacttctggcttaagtataaccatgtaagaattataaattttagttttctgaacccttaaacttttttagcatgtggtctgttacacatgctaaaaaattagtcttacttgtaacagcgtaattaaacacatcatggaggagagaaacttaaaattaaaatagtattttggcttttgaagttatttgtgttgctaaatagatgcagaggttttacagcagtttattttaaggttttatttatacataattactttgaactcttcagagtagatattttttcacaaggcagtttgtcataaattctctcatgcgcttcagaatgcataagtgccatcctttaatcatagactttgaggagagaaagcataaaaatatagcatataatctaaaaataaatatataacatgcacaaataatgtgacattcttactgaatcaaatcatgattctagaacttgagatcttaaatagaatttcggtttgtatcttccatataataaccacacacagataaccacacaaaaaatcctttgtaaaatttctgattgataggattagagtgcttaaatttttggggggggaagggtggggtaaagtgtaagtgctttcttttgtccctaacttgtgtattgatggcagtccactctgttttctaaaaatgtattttactgtggtgcttaacttcttattaattaaatcccgtatcagaaaccttgcctgtgactttagaaagggcttttgattattgttttttcttcttgctcttgaaagtaatctggtcccagggaattactggtttaactgaacatctccagaattatttaaggtgtcaaaatatataaccttcacattgaaagataattttaatttatgggcataataaaaatttgaatcattcaggtaattttcaaaaaatggagaccatttgtctttaactgaaggtatatgtttaagatcatagtctaccctagtatggtgctttgccacaaagtgatttctgaagaatggttctttttaagataatgacttcatatgatcattgtttcatgttacttgccacaaataactttaatttaggttgaaactggaactgtttgtttctcatattagctacttctctattaggagcacaagaaccatagttaaatgcaacatgagctactttagtcctgtttgtttaaatttgtgttgtccatgtattatgatttattaacttgttgatgcatgtaaattgggtgcattttgttgccatgtatgttaaatggtgaccaatgtttttacaaaggaattgaacaaaaaaagtatcttttaagaaatttggaatgtggttttgattttgaaatttgatttcttactaatctcagagggccttggtatattctgttactaaagcaaacaggattaatgaatacggatttgttacaaggtggcagcaatgtcactgagatagtgaatggaacaatttaccacctccctggaatctgcacctgagatacaacatcagcgtatgagtgaagagtgagcccatagaaaagctttagatagactcacataagtcacactgatgggtatttacagcagatatatccaagctgtttatgtaatagtctcatttactttattctttttctctagaacataaattttgaaggtaatggaagtttatcttttataccaaaagtttgtatgagccattttgaagtaaatctttctaattttagaattatattttctcgccatcttaagacagtatattaaatataatataacctttttcttagtggcta

SEQ ID NO: 51594 - DNA, 936 bp, Homo sapiens
  misc_feature (129)..(129): n is a, c, g, or t
tttgggatggctgggcacgcaccccaagaatggagcccatggaggcgctgaacacggcgcagggcgcgcgacttcatctacagcctgcactccacggagaggagctgcctgctcaaagagctgcaccgnttcgagtctattgccattgcccaagaaaaattggaagctccaccacccaccccaggacagctgagatatgtattcatccacaatgcgatacctttcatagggtttggctttttggataatgcaattatgattgttgctggaacccatattgaaatgtctattggaattattttgggaatttcaactatggcagctgctgctttgggaaatcttgtgtcagatctagctggacttggacttgcaggctacgttgaagcattggcttccaggttaggcctgtcaattcctgatctcacaccaaagcaagttgacatgtggcaaacacgtcttagtacacatttgggcaaagctgttggggtgactattggctgcattctaggaatgtttcctttaattttctttggaggaggtgaagaagatgaaaaactggaaacgaaaagttaatcctcttagaatacctataaaaagatgtaaactaatgtacctcagtaattaaatatgctgtcacaacatttaggaattaagacagtaacagtatagatatgggatcaaataatttagcatgtattatggaaaacactaacttattgtggcttgatcttcttaggacatcttttttaaaaagctgtttagtatcattttgtgtatattgttgaaatgctttttcatcaatagcagtcaacattttatcctttctttttatattcataatgttagagatacgtatctctaacattacatctccttctcttgcattccttttctttctcattctttctctctctctctcctgcgttatctttgtgc

SEQ ID NO: 51595 - DNA, 823 bp, Homo sapiens
agaagtccctccatttttaaaatatcctcaataattttctgtcattaagcattctctgacctttagtagctgcataatatcagatctcctaaataggccataatttttaacctgtctcccgtttttagatatccaaactcttttcagttttataatagtataattagtactataatgtataaaccatttttacttgggaatataagttttattggggataaaattataatttttagggcaaatttctagaaatgaattcagttagtaagtatgaatattaatacatttgatacatttttccaaacatccctgcagaatagttgtgccagttttcagtgccacctatgaaatgtaaggttacttttttttaagtcaaataactttaaacttatgagatttggtggtgtttggtttctgctaaaagaattatttgatttgttttataagcaaaaaaattattcctgattgttttataaactgcataggctatgcttacattaagaaaaatatcacttgtaatatggttatataaccaaaatagtagaatgagtaggagctttagtttatttagtttaattattagacttatttcagtaaatacaaaaacagaaaatttttaaattccactatagggaactaattttgttcacaaaatattttagaatgaatattctaaatattcattctaaaatattcttttcccgtttcttatttcttcccttccccccttttaaaccactttgagatataattcacataccatacaattcatccacttaaaaggttcaattcagtagttttgagtatattcacagagttgtgc

SEQ ID NO: 51596 - DNA, 330 bp, Homo sapiens
ccaacaccaagtatgcccccctaaccaatcacataggatgctcgcctctagccagcccgcctgcagcttccccaggtcatggtctccatcagggcacacctgatgccttctcttttttctactctgaagctttcccactcctctgccttccgttgagtctctgcaacaacgcaagtaatagtgggtgattcacttgttgtagcaagctctgaatgaacaacttttcatagttctcatttgattggtcttcttttaatttctacacaatgcattaagtgtatattgaatgtcctctataaatatgcattctggtggagaaggcctaagacc

SEQ ID NO: 51597 - DNA, 229 bp, Homo sapiens
ccatacctggctaattttttgtatttttagtagaggcagggtttcactatgttggtcgggcaagtctggaaactcctgacctcaagtgatccgcccacctcagcctcccagagtgctgggtttacagacatgagctactgcactgggcctttcacccatatcttgtccctgtgtgtcagttttgcaaggcagtaatatcgaaaccaaatcctaaagcagtttataattt

SEQ ID NO: 51598 - DNA, 365 bp, Homo sapiens
acctgcaaaaactaactgatgatattaaaatatctgacatttctaatggagataaagttacaggtatccaaacatcactactactactaaaaactcacctgttttaagtgtatagtttgaagagtttttatacaagtacatacatgtagagcaacaacctcagtcaagacatagaacattttcatctcccccagaagtcctctcaggcccctttatactcatccgctcttcccacaggcaactattgatctgctttctgtcactgtggcttagttttgcttgtgccagaattttatttgtttgcttgttaatatctattgatatattttcagtgaacattacctattcactaaaactgaaccagc

SEQ ID NO: 51599 - DNA, 811 bp, Homo sapiens
tggggatgtataagacaaccatttgacacaggtagaaaacttttacttttttaagcccattcccctggtaaacaatatatgtacacacctacatatttgaggtatgtgttcaggtttttacttatggggtcacaatatttaggctttcccttaatttattaacaggataataatagtactccagcttcaaaaaattgtgaaaattaaatgttaagtatattaaataaaacacatataatatatacatgtacatataaagtatttaaaataaagcctcacatttgtgattaatatatgctacctttaggaaaatgatttaacctttatggaaaggaaaagaaattgagtcctcacagagttccaggcactttcataatcatttctaatcccaaacactttccatgagaagtagttactgtctccactttagcaataaggaaacctatatttggggatttagtacccaggagagttgtttcagctaagtacacaagactgaaaaacagcctacatgattttaactcccagacctattttagagtgcaaatacttttttagaatattaagataaacctaaatcaaattttttatatagaagcttatggtcgtgaaaagtttattggtcaattttattatacttcctttaaaaattcaaaagaaaatgtgttatttaatagttaaccagctttttcagataaacatctttctccttcagcagaacattgctaattactatttctgtaccctgtccctttctataaaaaatttcccaaaattataccgtgaaaaagtgttcaagtaaacactgctg

SEQ ID NO: 51600 - DNA, 343 bp, Homo sapiens
ctctcagggaggtggtgtgggggaagcacctctctgaccagacctgtgtaccctcttctttccttaggacaggagtgactagggtcatcaaggacaagctggggccagagagacatttcccagagtgactccagctcaaggcctccctgtggtcaggcttctttgtgtgtttgctcctagataggcctctctaggtactcaggaggtggaatagaattccaggaccatagccccagatggaagggagcttagagactgtctctcttaatagccccattagataaataaggaaatcaaggttctgagagaaaagggggctgggccagagtcacccagcaagtca

SEQ ID NO: 51601 - DNA, 454 bp, Homo sapiens
  misc_feature (446)..(446): n is a, c, g, or t
  misc_feature (450)..(450): n is a, c, g, or t
ttttgagacagagtcttgctctgttacccaggctggagtgcagtggtgtgatctcggctcactgtagccttgacttcccagggtcaagccatcctcccatctcagcttcctgaggagctggaactctaggcgtgtgccaatacaccctgctaatttttgtatgttttgtagagagggggtctcttcatgttacccgggctggtcctgaactcctaagctcgagccatctgtccaccttggcctcccgaagttctgggattacaggtgtgagccaccacgccccgcccacagctaatgttgtagttgctagttctccatattgattaaagcaacaataacagtaacctctacccttttgaataaaagataatgagactattataatttcaggccctcagatgatgacttagattttcaaaattgcatttgactatgaatgtaggganaaanaaaa

SEQ ID NO: 51602 - DNA, 439 bp, Homo sapiens
ggggttccaccctgttgctcaggcttgtcttgaactcctgagctcatgcagtctgcctgtctcggcctccaaaaatgctgggattacaggcatgagttaccatgcctggcctcaggaagatgtattctttaagttataagtgatgtaggattatgaaataatataaaagtaaatagacaaagcaaaatagaataatatgaaaatacaatagctgccatttttataattatccccaatttacagatgaggaaactgaggcttgaagagaatacttaatttgactgataccataaaactagtaagtagaagaacaagaattagaagccaattctgtctccaatacctgcgttctcaccactacacatattgctttctcctaaagaagcaatggtgtcccctacctgagacaggcagtgctaatttgtcaatacctgtaaga

SEQ ID NO: 51603 - DNA, 202 bp, Homo sapiens
tgatgaacatttggctattatgaataatgttattataaatgtacaactatctgtttgagttcctgcttgcaattcttttggacatatagctggttcattttttttcgacccacctacctgtttatgtttttagagatagggtctcactttctcatccaggcagtggcacgatagctcactgtaacctcaaacttctgggctc

SEQ ID NO: 51604 - DNA, 497 bp, Homo sapiens
gtgttatgaggatataggagtggctcagaatcccaggttgcaagtctcccagcactgtactcggccatagttcttaaaccgcatgtgaatctataattatctcaaagagcatgttgagatgagggaattgcaaccatgtgtgaggtgagggtatagtgttctagtgtgtcatagtgagggacaaggctccatcccgaggctgtaggggacagtccattctttcagtggttgttggtgtcccttgacttgtggcatcactccaaaacctgcttccatggccacagtgcctccttcctatgccgccgcctctcctcagtgtgtgtgctctgtgtgccctcttataaggacatatgtcattggatttagggcccagttggctaatccaggataagtcttttcttcaagatccttaatcaccttttgtcatataaggcattacttgttcagtatgtaaagggtatgagaagcctgtgcaatgtggcaagactcctatctac

SEQ ID NO: 51605 - DNA, 1013 bp, Homo sapiens
actggctaatggtaacctgggggaggaagtcgggtaagttgcatggagaaggcaacccttgaacacttgcaaggagctaacaatacctgcttctggagtatttaaacgccagtgggtatgctaaatacttttacctcttagaccacctactaaccttacaaagtagtccactttgctcacccagttttacagattgatgaaactgaagcagacagatattgttaacctatcaaaggtcaccctgcaagtgtgtgattatagtccaagcagcttgtacttgttgcctatttgttttgcctttcctgtgcatttgccaggcagatgagagtggggtaagacattgcagagaaaaagtaagaaaaggccgtcatgaaacaatttcattttcagaccttataagcacgttacaagtactgatatttatgcttaagttcacgggagtcctggccagaaataaagctggaaggacaagtggggggcagattgtgaaggatccttcaagacctgcttcctctagagaatgggagactacccaagataactaaacagggaagtgatcaggttttgtgtcttagaaaagtgttgcagtgttgatgcaaatgtgactagaagggtgacttggaacctggattgaagggtgggagatgggagaaaggaatgcagtctggcagcagctacagcagtccaggtgggaaaacccagagcctgaactaaggttgtaactagaggggatagggtggaagagctggattagagatgttgacaagataaagtcagtaggacttaaagactgacaagtaaggattttccaaaagtgagagctgtggaatgaattgtcttaaaatgttgcagtgagttcctcctcatcaatccaagtgctcgatcagaggctagacctttagttagcagtcacgggaaaattccccattctcacggggatttagactaggtcttaaccatactttaccaagattccagtagcaaagcacccaaaagtaatcgcaataaaattc

SEQ ID NO: 51606 - DNA, 240 bp, Homo sapiens
aaaaatattgaggtaggttaggattttttttgttttatattcaattatagaatatatttccctgtgtcataatgtgattaggtcattaattacttcattggcttcaaaagcacaataataatcactttgtaaagcatggtaataatcacatacagcaagaaaacagtatgaataaccttataccttttattttaatatcattgaccacccaatcacatatgcacaatactacttattttc

SEQ ID NO: 51607 - DNA, 937 bp, Homo sapiens
gacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaagtactattttaaatatacatgtgtttatataagtgatgtgctttatt

SEQ ID NO: 51608 - DNA, 1012 bp, Homo sapiens
gacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaatta

SEQ ID NO: 51609 - DNA, 568 bp, Homo sapiens
atatacttgttctgtttcaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaatta

SEQ ID NO: 51610 - DNA, 503 bp, Homo sapiens
gacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggtatttgtgaaacatggggtaggtttgaaatagtgctct

SEQ ID NO: 51611 - DNA, 321 bp, Homo sapiens
tcccaggtttccaagcacctgcccacttacactcaagacagccaggaccactctgtaggaggggaggccgggacactgcaatgagcccggattgtcagctgttcccagccccttgccttagtgacttcaggcagcacatccctgattccaggagtccatcgggtcctggcatcttggggactggctggacaaacgctggactgcaaataatccgtgttgccagttgagtttccacaagtcacagcatattcttttaatctacaaacctgggtcctattgtgtgaaccaaaaatgcaagtttgattcagttccatgatgcca

SEQ ID NO: 51612 - DNA, 2442 bp, Homo sapiens
  misc_feature (2386)..(2386): n is a, c, g, or t
atgtggatgatacagtgtactacgatgttacaatggcacagtggctatgatgtcactaagcaataggaatgtttcagctccattacagtcttatggggccattgttaaatatgcagtccatcactgaaacgcatggctgcatgtggtagaaggtttcaattcataaatattaatttatactgctggtttatgactaacccaggaaactgcataatgattaacaaatgctacgatataaccaagtgaattgcaaagtcatctacacctgtattaaagttcagctcagaaaggactgtttggactgtgtgtatctagcactacgtagaagagaaagtcaagggcaaagttcccactctcaagaactttatcttgttgggttcatgaaagggtttctggtgacacagagtaggtatataatcagcaaaatgtggtctgcggttcaaatgagtgctcatgccagagattggttgggtgccagctatcagttcttccaccctgtccctggaagctatctgctacctctggggctggcacaacccagggtgtggctgcgactgcctagggtgtggccactgtgaactgagctgcatccccttcctggtgcacacccgcacacacaaaagtcactctctaaggagtgggaatatctatctcttcgccttggaatcttcagaaaataatgatgtagcaaatgatagtttttttgaatgttgatttaattaagctgattctttctttgaaagagaagatttaatgatttttcactccctattgcatttatgttttccacaactacgacaagagttttctctgtgttctgaattcttctttcttaagatttctctttctggattagtcataaaccagtctttcttaaatacattcagtttcttccctggtttcaatagatattgagggaagaaacggaaacctgaattggttagatgcatactttataccagacactgtgccagatgatagagattatttcaggtgtgtattcaggggacggggtgcgtggtggtggtcattctgaaagacacctgcagttgcagctcaaatcatttattccgtaagtatctatgagcgtgcacactgtgcttgacatggaagatgccagacaaacgtggtcctgctctgttttaagtgaaggttgttatggtgtataaagcaggacacctcacttggtaggagtgcaaggaggtatcagggagggctgttctgctgcccttctcgcaggcagcttttcaggcattgctcctgcacctatgcagacgtgtccatggctcgtgcgggggaccctcagggagaacagtcacgctgctgccccaggcacttgcactgtccctatgactgagtatgcatcctctgcaaaccactgctgtagcatcagactctgggtacccttactgtgaattcactgcctttccaaggtcctaactgttgctggctctgcttgtcatcatccagattcataacgccatacataccttaacaaagtgtgaggagagtaactttcactagggtgcaaatgcccatcaagtttaacctcacagattgcatttatactttaaaagaggagctcagtagtaaatattaatttgtaattatagattctaactgtggattgtagagcagttgctttgctgtgacaggcatctatgcaagaggcacttctcttatcttgccatctacctaccctagcctcttaaaattaagaaaaatagaagtcagtgactaagccaccaaatttgaatgtgttacctgggctagctggagtgttttgggggagaattctaaaacctgctctggtcttagctctgccctcatttactgagcctctatttccttttctataaagtggagctaataggagttttgtgaagagtaaaagtgagctgaaaagtgctgggctgacacaaggtagccctgcacatagccagggagcccagcatcctgtccaaagattagagtctgaaagctcactctactgatttgcaaactttaacctaaagcaaatatgcttaattttattgtccttacatttattgcttctgagagacaccttttttttttttaaggcaaggtcttgctctgttgccccatgctgcagtgaggtggtgcaatcatagctcactacagcctcagcctcctgggctcaggtgatcctcccacttcagcctcctgagtagacatgagagtctccctgtgtggcccaggctgcctggctcaggagttcaagaatagcctggccaacatggcaaaacctcgtttctactaaaaatacaaaaattagctgggtgtggtggtgcgcatctgtaatcccagctacttgggaggctgaggcaggagaatcacttgaacccgggagatggaggttgcagtnagccgagatcgtgccactgcactccagcccgggcgacaagagtgaaactccatctc

SEQ ID NO: 51613 - DNA, 416 bp, Homo sapiens
taaataatagagacaaggtctcgctatgctgcccaggctgatctcaaactcctggactcaagcaatcctcctgccttggcctcccaaagtgctaggattataggagtgatccactatgtccagcctccaaatcctttctaaacactaggacttttcatgaaaagaaaaaagctatgccagttagacacacacagaaatctcatgattttattttgaatttctttgactaaattgaacttacaaataagtttattatggccaggcgtggcagtgcacacctgtaatcccagcactttgggaggctgaggcgggcagatcacttgagctcaggagttcaagaccagcctggcgaacatagtgagacctcatctctacaaaaaatacaaaattagcggccgggagtggtggctcacgcc

SEQ ID NO: 51614 - DNA, 400 bp, Homo sapiens
ggaagggtgaggattgaaaaactacttaacgggtactatgcccgctacttgggttgtgaaattatttatacaccaaaccccagtgacacgcagtttaccagtataacaaacctgcacatgtaccccctgaactaaagcaaaagttggaagaacaaaaataaagacttcagacaccaactacaactttgggagtttccaaaaactaccctctggttcaaaattcactagaaagactcacagaaccactgaaatatattaaagtcacatccattgtagtcacattatacaaattacaaccagccataggaagagatgcataaggcagagtctttttttcctcctctgtattagtccattttcatgcttctgataaagacatacccgagactgggcaatttac

SEQ ID NO: 51615 - DNA, 240 bp, Homo sapiens
ggagaggaaggcatctgtgctgggggtcaagggacgtggagtggtctcagccactgtctgtcttcatcctgtatttgccatgtccatgcgagagcatgctggacatgagtttccctcaccccttgacctctttggagtagacatgttacaatcagtttcaagcccatctctggtctgaggtgagaatacagaatatttacttacctaccccctgcccaactttggtttgactgactgttt

SEQ ID NO: 51616 - DNA, 2387 bp, Homo sapiens
caaaaaacccaggctccaagggattatgacaactaagattcctcttactggagcaagaactaccccataggctggaaaaatagcttcatgaagtttaagaacaagcaggaacatgggagaaatgaggaattccagttcctatcttgtaaaaatgctttcatatgtgacctgagggaccaggagaggtgaagggagcccctggttctcttataaaatctctaagtttttacaccacttcaagaaatatagtcagccctctttgtatagagcattaggaagcaagagcgtggtgaagctgacatttctcaggcacattgacatttaaaatacaaacttttctcttaaagatctcactggttggacatctcttctcctccgtccttcccttcgctctacttttgttccaagccgcccctgcctctccagggctaggagtgggacaggggtgggagaggtggtctcaccaggctgctggccccacggagcctgtctccctggggatgggaacggggatagaagacaggggaggaggcgcgcgcccgttttgggggttccgggtaggctgtgaggaccgcttttggtgagagtgccttgagcagcggggagcagttggattcaacttcagggcacaggagaagttaggagaagagggagagggaaagagtgggacacacagaaccagggtgcccagccaggcgagggtccgaggcaggaacgttctagcctcttcccgtgcgagtcctgctgcctctttgagcctccgtgtcttcatcactgaggaagggatttgacctgatgagaggaaggtgcccctggcttcccagtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 51617 - DNA, 1356 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggggtccatgcgcggagtccccacccggcccggcgcctgccgctgacggcggcgggggtgggggggcgcgcgcctggcctcctgcccacccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttattaacgccggagacgcatcgtgccagcttatgatcgaacaatcccaccgaccacggcagtggcagctttcgcccagaagggcaggcccacgggggtaccgaacggcacccactggccgcgggcccgagaaaggaggacacgacccgacggacaaggcacacacagcgcggccggacccccggtgggccaaaacggctggccgggccaaaaccacggccggagaccacacgggaggggcaccacaccaccctcaccggggaccccgcaaagtacaccccgataaaaacgcaacac

SEQ ID NO: 51618 - DNA, 276 bp, Homo sapiens
ctcggcctgtacgacatgagaagatctggcaccacaccttctacaacgagctgcgcgtgccccggaggagcacccatgtgctgctgaccgaggcccccctgaaccccaaggccacacagatggacatagagccaaacagccccaggtactgcccggcaaactcagatataaccacacttgggcccggactgaccacggtgccctcttgcacacacgtgaccctggccacatcacagtcgggctgcagccgagatcacacgcacacaccactcacag

SEQ ID NO: 51619 - DNA, 2093 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgtgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 51620 - DNA, 2042 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgtgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 51621 - DNA, 2300 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgtgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcggcgggggctggcaggcatgtaattgccccaagcctgaggctcccttggtctccatcctggggagcgcagagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 51622 - DNA, 2959 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgtgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagaggtgtgagggtctaagggctggggattgtgcaattctcaaacctccattagacctcaggactccaagagtgggcacttccagagtagtgggtcagcctgggtccctgtactgtgggttctctgaggcttgatgggaagatattcatccatctgtccgtccgtccatccatccatccatccatccatcctcctcctccatgtatccatccatctacccactcactcacccatccatatctttatccatccgttactcaattactcattcacccgcaatccatccatccaaacctagtccacccacctacccactcattacccatctgaccacacattcacccactcactccattcatctctccactcgccaacccactcatccatctacctccacactgaccaaccacccacacatctacccatttatctgtgcattcacccacctccctacccaggcttccacccacctacccatcaactcacccatccatccacccacacatcccattatccatatatccacccacccaccacccactatccatccatccatccatacctacatacacccattcatctatgatacatctccaaacataaactgagcccttggctgggcacggtagctcacgcctgtaatcccagcactttaggaggctgaggcaggtggatcacctgaggtcagaagttcgagaccagcctggccaacatggtaaaaccctgtctctactaaaaatacaaaaattagccaggtgtggtggcatgtacccatagtcccagctactctggaggctgaggcaggagaatcacttgaacccaggaggcggaggttacagtgagccaagatcaacctgggcaataaagtgagactccatctaaaaaaaaaaaaaaaaaaaaattgagccctcactccatcctgacatgcctcaggtagggtctggatcttgagaagattctggtcttgtggggaagttggcaaccccagtgacaatccagtgtaacagttcaaacaataaaacgtagtttccccataggagggagtcatcagctatctctggggtatcagggaagatttcctagaggaagtggcctctggatggggcactgaaggatgaataggagtccactgggcagagtagggagtaatgtggaaggggggcattatttgactttcccaggccttgagtcttctgtggcctggtatgatggcggcactttagagcatcttctcatttagtccttacaacgatcccgaaaggggagactattaacaattttaatttcatagataagaaga

SEQ ID NO: 51623 - DNA, 1118 bp, Homo sapiens
aggcggagtttgcggtgagcagagatcgcgccactgcattccagcctggcgacagagcaagactccatctcaaataaataaataaataaatggatagggagagggccacacagagactctgacagattcagagagggagggcctgggctttgcttccctccccgacgccagtgaagcccctcccccacgccacaggagccccctcccccaacacagtctctctaatcagagctggccagttaacctctaattgctggaacaggcgggggctggcaggcatgtaattgccccaagcctgaggctcccttggttccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 51624 - DNA, 1751 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgtgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttattaacgccggagacgcatcgtgccagcttatgatcgaacaatcccaccgaccacggcagtggcagctttcgcccagaagggcaggcccacgggggtaccgaacggcacccactggccgcgggcccgagaaaggaggacacgacccgacggacaaggcacacacagcgcggccggacccccggtgggccaaaacggctggccgggccaaaaccacggccggagaccacacgggaggggcaccacaccaccctcaccggggaccccgcaaagtacaccccgataaaaacgcaacac

SEQ ID NO: 51625 - DNA, 1718 bp, Homo sapiens
cgtccgctcgcttcggcggacagtgggttaagcatctccgccgtggaacttccggatgtgaccacagagagggagagaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgtgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccaggtgggcccgggacgggcaccaggcatcgtcctgcagccacagctgtgcctggacaccgcatgagggcgcatgtgcactacacagcctcagacgaagccacagtcagcctgatcacagggcacgcatatgcacacagccacacacccactacacaacagctacgcagactcggatgcggctgggcaacagtgcacagacacacgcacaccagcggctgcagatgccacccacagattcagctacacccacacaggtccacatacagccacaccaactcagcaacagccatttctgctcacagccagacagtagcgtccaccgggtactcacacacgccccccagcccagccatacgacagcagcatagaacacacagccgggttccgcacgccgttctcaattgagtatgtgtccactgcatacacacacccgctccagccacacagatggacatagagccaaacagccccaggtactgcccggcaaactcagatataaccacacttgggcccggactgaccacggtgccctcttgcacacacgtgaccctggccacatcacagtcgggctgcagccgagatcacacgcacacaccactcacag

SEQ ID NO: 51626 - DNA, 824 bp, Homo sapiens
ttacaggcatgagtcaccgcgcccagcctcctgtctctctttctctctctccatttcgtctatttcttcatgacttcttctctctcttcccatgtcgttctctctgactccctccaggtctgtctctgtcctactctgcctgtctctctccttgttctctgtctctgtctgtaggtctctccctccctcacctccactctgattctctgtctccctctttctcgtcactgcgtctcttctctctgtgaccctcccacatccctgtgccattccccgccagccactctctctgtgtccccctcacattggggctgatgaggcctgcacagatgggctggggtggggccaggccccctgcccgctcctgacttggcctctcctcccctctccacagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 51627 - DNA, 348 bp, Homo sapiens
cctctctatccccctctctctgccctcccccacccgcagtctctctcctctgttcctgggcttcctcctccatctcagccgcccgcacctcaccgtccccccttttttctgctctcctccgtccttcccttcgctctacttttgttccaagccgcccctgcctctccagggctaggagtgggacaggggtgggagaggtggtctcaccaggctgctggccccacggagcctgtctccctggggatgggaacggggatagaagacaggggaggaggcgcgcgcccgttttgggggttccgggtaggctgtgaggaccgcttttggtgagagtgccttgagcagcgggga

SEQ ID NO: 51628 - DNA, 232 bp, Homo sapiens
gcagattaaatctatatcaaaattctactatctactcacaggaaaagtataattttgaactacttttatataatattttgccaatattatagagaaaattaatttgtatatatttatgataggtatttaaattgcttgaaacatgtagaatactgcttagctgtatctagtgaagcaacacatatgcatatgctatatgttgtgaccttgggtagaagtttgaatcctgggt

SEQ ID NO: 51629 - DNA, 638 bp, Homo sapiens
accaatattgatatcacaatttttattctttgcttattaataagattttatttacacatgcgtattactatatgacattcttgtaaagtgaatttaggcatgctccatgccttcttttgttgctcaatagtgtcttctggttttggtcatctctatttgccatcatcttatcaattctatgatgatgtcaatgataataataatgacaatgataattaacctttgatgaatactgttttctatatatatatatatatatatatatatatatatatatatatatatatatacactcttgaggggcggtgtggtttaatagaaagtgaatagatttgctaataacaagatcttccttcgaattctggctctccttcctaccacctgatgattttgaccaagtcatgccttctctgcttcttagttttctcttctctaagataatgagattgagactgacactgagcgttgtttgggaatcacatgagaaaatgcatgtaagacacttagtagaacagctggtgctctgcgggtgctagtgtctttccttcctcaagaatatttgtcggataaagtatctagtatgatagttttgtgagtttcaaagaaacactatttgaagttgaaaacctcatgaaaat

SEQ ID NO: 51630 - DNA, 281 bp, Homo sapiens
ctgcttatagccttgagggtcctggcaagtcattaagcctctctgtgcctctggttcctcctctgtgacatagagataatattactagtccttttttacctcaggatcaaatggagagaaaatgacaacaacaaaatgaaagtgaaaacggtttgaatatcatgatctctgactcagcctccaaggcccaaacctcttacagggctgagaatacaggaggcccttggaaaatacttgctgatcaaatgagaagctccaagttggatttctgaaataatgag

SEQ ID NO: 51631 - DNA, 396 bp, Homo sapiens
ggctggggtcaggagctggctgagggcggctggcgagagaagagggccctggagagggccttaaggggcttagcgttagctctgagcctctggtctggggggttggcgacagcagcttgcaagaagggtggtgagagcagggctgggggctttgtttccggccgcgggtctgcggacactgcacaaaatggagggggaaagggggtgagcgcgcagctggcgtgggtcgagcggactgctattgggtggaggaggctggagagagcagcgtccccctccctgcggctcagccagcgccctcctctcgtgccgtaaaggtcaagtcctccgcgccacggccgcctctatggtcagggccgatcgctgccgccgcctcaagaaggcacaggacgcaca

SEQ ID NO: 51632 - DNA, 2178 bp, Homo sapiens
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcctagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccactattttagttagaacttataaaaacttttatgctggctgggcgcggtggcttacgcctgtaatcccagcactttgggaggcggaggcgggtgtatcacgaggtcaggagatcaaggccatcctggctaacacggtgaaaccccgtctctagtaaaaatacaaa

SEQ ID NO: 51633 - DNA, 1412 bp, Homo sapiens
acacccattctggggagggtaactgcctatttcatagctatttagagaggatgtcaagttgcaagccacagataaatttggaaataacttacagtaaaggcattgtttgtcccccctttttgttagttacttagagtttttctttcatatttaattttagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagattacctgaggttgggagttcaagaccagcctgaccaatatggagaaaccccctctctactacaaatacaaaaaattagccaagcatggtggcgcatgcctataatcccagatactcaggaggcagaggcaggagaatcgcttgaacccgggaggcagaggttgcggtgatccgagatcacaccattgcactccagcctgggcaacaagagtgaaactccgtctcaaaataataataataaccaaaatgagtgttctgcagataaaatgcattagactttgctagactaaaactttactaaagattagggtttttaaaaaatgccaataggccgggtgcagtggctcatgcctgtaatcccagcactttgggacgctcaggcgggcggatcacaaggtcaggagtttaagaccagcctggccaacatggtgaaaccccatgtctactaaaagtacaaaaaaattagccgggcattgtggcgtgtgcctgtaatcccagctactcag

SEQ ID NO: 51634 - DNA, 902 bp, Homo sapiens
ataaatgtagagttaaaacaacaatgatcaaatattttaaaaaaaacagtactggtgaggctgctttgaaatgggcactcttgttactaatgactgaaaattagttcaaccgtttgagaaaacatattttaccatatgtatcaggagctttgaaacatcatatcccttgacaaaatgattttgattctgggaaatttattctaaggataaaaactaagaaaaaattaaataacaaaaacatgtttgtatagctttagtaaacatgtcagtaaagcattagaaatagctaaatgtctaaaatagaaatagttatgtaaactgtgattcataatattggaattttatgcaattggttgtatcccatttatttctctacctgtgttatatttatttctctaccacttaccacttttgtgaccttggacatgttacataacctttagtacctcaattttctcattgataaatgggaataatctcttaggttattgagattattaaatgattaatactgtctagaacagtgcctgataaataataagcattcagtaagttttaactgttattattaaaaagtttacaataatgtatgaccagtatttctgatgtgaatgtaggatataggccaggtgcagtggctcacgcctgtgatcccaggactttgggaggccgaggtgggcagatgatctgaggtcaggagttcgagaccagcctggccaacatggtgaaaccctgtctctgctaaaaatataaaattagcctggcatgctggcatatgcctataatcccaactactcaggaggctgaggcaggagaatcacttgaacccaggagacaggttgcagtgagccaagatcacaccatggcattccagcctgggcaaaaagagtgaaactgtgtca

SEQ ID NO: 51635 - DNA, 783 bp, Homo sapiens
acaaagctgttaataccctattttatattaaataatgttttctttcctttcatatgttcagacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcaggtactaatttttatatgaaattgagaatatttgctgatgtgtaagtatttgtgaaatattttaaaagatgctctataagataattttatattttcaagggtatatttttttgttggctccagaatatgtttgcaaagataagttggttacttaaatgtatcatattctatctatgaaaatttaagattatcttattcattaagaaacacactggacagccgggtgtggttgctcatgcctgtaatcccagcattttgggaggctgaggcaggtggattgcttgagcccaggagttcaagaccagcctgggtaacatggtaaaaccctgtctctaccaaaaaaa

SEQ ID NO: 51636 - DNA, 2879 bp, Homo sapiens
  misc_feature (529)..(529): n is a, c, g, or t
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattatgntgaaatgcttgataccaacttgattcttctaccttgttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggtgcggaaacccaggacaagtagaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagattacctgaggttgggagttcaagaccagcctgaccaatatggagaaaccccctctctactacaaatacaaaaaattagccaagcatggtggcgcatgcctataatcccagatactcaggaggcagaggcaggagaatcgcttgaacccgggaggcagaggttgcggtgatccgagatcacaccattgcactccagcctgggcaacaagagtgaaactccgtctcaaaataataataataaccaaaatgagtgttctgcagataaaatgcattagactttgctagactaaaactttactaaagattagggtttttaaaaaatgccaataggccgggtgcagtggctcatgcctgtaatcccagcactttgggacgctcaggcgggcggatcacaaggtcaggagtttaagaccagcctggccaacatggtgaaaccccatgtctactaaaagtacaaaaaaattagccgggcattgtggcgtgtgcctgtaatcccagctactcag

SEQ ID NO: 51637 - DNA, 1930 bp, Homo sapiens
  misc_feature (1912)..(1913): n is a, c, g, or t
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgtacatattacgnnggatccgcaggcaccca

SEQ ID NO: 51638 - DNA, 1514 bp, Homo sapiens
tttttatatatcataagtatttatttccacagcagaaaattagttgaagacaagaatattcaaaaaataaacatgtttataaaataaagtaaagaatgaaatgttataagggtacaaagtaaatgctgatatattaatagggtggttggatttagcaattttgcaagccacagataaatttggaaataacttacagtaaaggcattgtttgtcccccctttttgttagttacttagagtttttctttcatatttaattttagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagattacctgaggttgggagttcaagaccagcctgaccaatatggagaaaccccctctctactacaaatacaaaaaattagccaagcatggtggcgcatgcctataatcccagatactcaggaggcagaggcaggagaatcgcttgaacccgggaggcagaggttgcggtgatccgagatcacaccattgcactccagcctgggcaacaagagtgaaactccgtctcaaaataataataataaccaaaatgagtgttctgcagataaaatgcattagactttgctagactaaaactttactaaagattagggtttttaaaaaatgccaataggccgggtgcagtggctcatgcctgtaatcccagcactttgggacgctcaggcgggcggatcacaaggtcaggagtttaagaccagcctggccaacatggtgaaaccccatgtctactaaaagtacaaaaaaattagccgggcattgtggcgtgtgcctgtaatcccagctactcag

SEQ ID NO: 51639 - DNA, 1767 bp, Homo sapiens
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcaggtactaatttttatatgaaattgagaatatttgctgatgtgtaagtatttgtgaaatattttaaaagatgctctataagataattttatattttcaagggtatatttttttgttggctccagaatatgtttgcaaagataagttggttacttaaatgtatcatattctatctatgaaaatttaagattatcttattcattaagaaacacactggacagccgggtgtggttgctcatgcctgtaatcccagcattttgggaggctgaggcaggtggattgcttgagcccaggagttcaagaccagcctgggtaacatggtaaaaccctgtctctaccaaaaaaa

SEQ ID NO: 51640 - DNA, 380 bp, Homo sapiens
taaaaattaacataaggattgtacttctattgtgcagtaaagaaattgtacttccatttcttgggagacttatgctagattttaatattagtaagtcaaatgtttgctattaaggaaacaatcatgttttaaatgcatttacagtatcagttgaggtttagacagttcttaacttaattttcaagatgacgtcagactattcacagaagaagaaatgaaactggtgcacagatataaagaaatgttcaacgttgctggtaataaatgtagagttaaaacaacaatgatcaaatattttaaaaaaaacagtactggtgaggctgctttgaaatgggcactcttgttactaatgactgaaaattagttcaaccgtttgagaa

SEQ ID NO: 51641 - DNA, 234 bp, Homo sapiens
tgcatatattagcatgtaaatacataaaataatcattttctattttgttttgtgaggctagaaggtccagcttaaaaaatgtgtccgacctttttgtgatgggaggagctcttgttttagaatctgcagctctcttgcactggctagagagggaaggttacggccctttaggaatgactggaatatccatgggaggacacgtaagcctttttatttctgcttacatttaattat

SEQ ID NO: 51642 - DNA, 754 bp, Homo sapiens
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatatgacgtcagactattcacagaagaagaaatgaaactggtgcacagatataaagaaatgttcaacg

SEQ ID NO: 51643 - DNA, 2839 bp, Homo sapiens
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagattacctgaggttgggagttcaagaccagcctgaccaatatggagaaaccccctctctactacaaatacaaaaaattagccaagcatggtggcgcatgcctataatcccagatactcaggaggcagaggcaggagaatcgcttgaacccgggaggcagaggttgcggtgatccgagatcacaccattgcactccagcctgggcaacaagagtgaaactccgtctcaaaataataataataaccaaaatgagtgttctgcagataaaatgcattagactttgctagactaaaactttactaaagattagggtttttaaaaaatgccaataggccgggtgcagtggctcatgcctgtaatcccagcactttgggacgctcaggcgggcggatcacaaggtcaggagtttaagaccagcctggccaacatggtgaaaccccatgtctactaaaagtacaaaaaaattagccgggcattgtggcgtgtgcctgtaatcccagctactcag

SEQ ID NO: 51644 - DNA, 2152 bp, Homo sapiens
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccaccgcgcctggcctagacatgcattttcttaagcctggagggatatgggttacagtagatgtgagtgatgggattatgatggtttcccttcctatgtttgg

SEQ ID NO: 51645 - DNA, 1315 bp, Homo sapiens
taggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcctagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtggtttctccatgttggtcaggctggtctcgaactcccgacctcaggtgatcctcccgcctcggccccccaaagtgctgggattacaggcagcatccaccgcgcccagctgaagaatttccactttggaaccaagcccagaattcagaataaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggagtaagtatttcactttccac

SEQ ID NO: 51646 - DNA, 225 bp, Homo sapiens
tttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgt

SEQ ID NO: 51647 - DNA, 328 bp, Homo sapiens
ccctggggggtcccttgggcatctcagcctggtgaggcactttcctccctccaagtgctggcacgtgaccaagagagggtggcatcaggaagcacctgtgcctgtgtctgtgtgaatcagatctgcctgtcgccgtgagctttgtgtctgcctggattggtgcgggggtgtgtgtgtttgtgtaccggcgtgtgattgttttggtttgctgtgatgagtgtgggtgtatttctgtgggggccatgagtgctctgtgggggtgtctgctgtgggggtgggtctgggtccccacatgcccgcggagctgtgtgtaggtgtctgtgtgctc

SEQ ID NO: 51648 - DNA, 227 bp, Homo sapiens
aagctaggcaagatggggttgcagtaaaatttttttctttctcctccatccaaactgtttttccctgggactttttcccaagcgacatgtcagctgtaaaaacacgaatcttccctctcctggtgccctgtgcccccccaccacctcccaaaacatatgctatttatcaaatctaagaataaaaagaatgcaatttcaagaaagcttttaaagatttcaatttcctt

SEQ ID NO: 51649 - DNA, 262 bp, Homo sapiens
ctgaaaatcaattcactgtaagtgtaagagtttatgcctgcattctcctttctgttccatcaatctatatgtttctccttaaacaccagtaccacccagtcttgattactatatgtttatagtaagttttgaaattactatagttttatagtgagttcttcactcttcttttttctttggaggcaggatctcactctgttattcaggctgagttcagtggcgtgaacatggcttactgcagcctcaacctccgggactcaag

SEQ ID NO: 51650 - DNA, 385 bp, Homo sapiens
gagattctcctgcctcagcctccctagtagctgggattacaagcatgcaccaccacacctggttaatttttgtatttttagtagagacagggtttcaccatgttggccaagctggactcaaactcctcacctcaaatgatccgcccaccttggcttcccaaagggttgggattagaggtgtgagccactgcacctggccaggattggaattattgggtatttggccccaaatgggaccctagctggacccgggagagaaaccagggacctggatgtctagggatgcagaccagagtgcttcgtggccagaccctggggaaagggggaggggaccaagaggaagggcagcagacccacgtggcctcgctccaactctgcagatgac

SEQ ID NO: 51651 - DNA, 336 bp, Homo sapiens
ctgcacccagacctcttgtagactttaaataatctctagttataataccgtatacaatgtaaatactatgtagaattgtgatattgtagttttaaaaatctattttttgttttattgtttattatttttttagacagggtattactgttactcaggctggagtatagtggcatgatcactccagcctcaacttcctctgctcaagagatcctcccatctcagtctcttgagtagctggaacttacagggatgtgccaccatgcctggctaattttaagaaaaattttttgtggagatggggtcttactatgttgctgtggtcagtcttggactcct

SEQ ID NO: 51652 - DNA, 388 bp, Homo sapiens
tctagtcttggccgcagaagcgagatgatgaagggaacgtcatcatttggaaagcattgcaataagacgtacacgttatgccaccactgtggctctaaggcctaccaccttcagaagtcgacctatggcaaatgtggctacactgccaagcgcaagagaaagtataactggagtaccaaggctaaaagacgaaataccaccagaactggtcaaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaatacaaaataaataaataaataaat

SEQ ID NO: 51653 - DNA, 545 bp, Homo sapiens
  misc_feature (529)..(529): n is a, c, g, or t
acattgggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggaatgtcccaagccttcgggtagggtaagcatcatggctggcagctcacaggattgcttctacttcaggcagtgtcgtgggcatcagatgagtgccttcagccgctacaagagcagaagcagtgggcattggatggagctgagtacaggaccatacaggctaattgcaccggcacaggaatcggatataacatcatccgggtacccatgggccagctgtgacttcttccatccgcaccttacacctatggcagacacccctgatgattttccagtttgcacaatttcagcctcccagaggaagataccaagttcaaggtacccttgatttcaccgaggccttgcagtttggnccagggttcccttttc

SEQ ID NO: 51654 - DNA, 920 bp, Homo sapiens
acattgggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggaatgtcccaagccttcgggtagggtaagcatcatggctggcagctcacaggattgcttctacttcaggcagtgtcgtgggcatcagatgagtgagtcaaggcagtggggaggtagcacagagcctcccttctgcctcatagtcctttggtagccttccagtaagctggtggtagacttttagtaggtgctcaataaatccttttgagtgactgagaccaactttggggtgaggatttttgaaaccgtcttcagtctctccaaacagctgtgtccgttctccacatccttgtcagacctcacctctgcttgtgctccctccctcccaggtggtgcccctgcatccctaaaagcttcagtacagctcggtggtctgtgtctgcaatgccacatactgtgactcttgaccccccgacctttcctgccctaggtgccttcagccgctacaagagcagaagcagtgggcattggatggagctgagtacaggaccatacaggctaattgcaccggcacaggtaaccattacacccttcaccccccgggccaggctgggtcctcctagaggtaaacggtgtcagtgatcaccatggagtttctcccctgggcactgataaccctgtggatgtcctcaggcctgctactgatcctgcagccagaagttccagaaagtgaagggatttggaggggccgtgacagatgcaggtgccctcaacatccttgccctgtcaccccctgcccagaat

SEQ ID NO: 51655 - DNA, 536 bp, Homo sapiens
acattgggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggtgccttcagccgctacaagagcagaagcagtgggcattggatggagctgagtacaggaccatacaggctaattgcaccggcacaggaatcggatataacatcatccgggtacccatgggccagctgtgacttcttccatccgcaccttacacctatggcagacacccctgatgattttccagtttgcacaatttcagcctcccagaggaagataccaagttcaagatacccctgattcaccgagccctgcagttggcccagcgtcccgtttcactccttgccagcccctggacatcacccacttggctcaagaccaatggagcggtgaatgggaaggggtcactcaagggacagcccg

SEQ ID NO: 51656 - DNA, 269 bp, Homo sapiens
aaaaattgatgtgaagaggtcttacaaggcttgaaaaataattgcattaatagcagaaggaaaaaataaacttcacagacacggaaaaacaaaacaattttgaagtacttttctgttttcataacttttacaagagaagagatggaataagatgaggttggcaactgttgcattcagagccctattcattaatacaactagccaaatatgaacatcaaacagataaggcagggggaacccatgctacatttgtagagaggaaaaaaaaa

SEQ ID NO: 51657 - DNA, 270 bp, Homo sapiens
ggtaggagtaaacttaggggatggagggagaaattccaggcagaaagattggcatgccctgaggcttgtgtcatcgttagtattttgattgattttattaccttattggaacaggctgcctatatggatgtggggcttagaatgggccacactccctcgaacccacccaatttgagatttaactctgcgatttcccatcatgaactaagagtaatttgagactctgagacgcatgtccattttctattttagatgaacgtagcttggtgc

SEQ ID NO: 51658 - DNA, 221 bp, Homo sapiens
aaccttaggcccaatgatacttatagctgagtatatcaagttttaatttccatttgctcagccatcataaaacaataccaagtggaaaccatctgtaattacattttcaaacactaattcacagaaagttaagcagagagatctatacatcagtttagtctattatactttaagcagatccagagaccataaaacaactcaaaggtagccttctgcttcac

SEQ ID NO: 51659 - DNA, 350 bp, Homo sapiens
gaagatcttttctttgaggcttatttttccagctgttttgttccacttttcatttgggttgaacacgttagagaactgctgtcatgtgtacctgtcttgctgtcaccgggctccttgtgtcagtgggctgtggcttttaagggcctcactgctggtctagaagcccccattcctgctctcttccctccagcatcttcatccggttttttgttgcctctacaaagttggaaagggtctctcatttcctggttatttcttctgatgatcttggtgtgcctccttcctgtgcagcatcagcatggacttctaggcttgccagtctccctgcccttggctttctgtctaggtct

SEQ ID NO: 51660 - DNA, 943 bp, Homo sapiens
caattttgttgttggaagttcatagtgtcagacgccagcacacttgcaacgcacgaaaatgaggtagttcacgacgccgtgtttgtgctgcctcggccgccccagcctccggggccctcctggctggatgcagctcagccatcagcgtcaggctgtgttctgaaaaatcagaggacactgtgctttgctttcatctgagaagataataaataaatcaggaactcggaaaatttcaaagtcatgactgattgtactgcctgatacttgccatttctcttgggtttactgtacatgtgaccagtgccaccaggcagccacaatcttgtctgtgggtgagagagagagacagacccgcttacatgaaaatcagacctgcagaaggttatcctagttccttcctggcttgtactgacgtcatagtcctaggatgaattcaccaaggtttcgttagggggcggtcacagttttaaagtgggctttgtggaaaagttaaataaatcattttaatttaagaaacggcaggccctactttactgaaaagctgacaagtcttggtggcttttcaagtggcagagatttctaatattgtttgaccataagacaaaacaaggaactgtaacagttttcccattttccttaaactgaagtactatttataaaatactttacatttttttaaattttcaaattatagacaaacctccctaatacaaaatactaaaagtgcaatagtataaattaagagtttgcaaccacattatacaaacattacctttttattgtacagctttgataatgtgaaatattttctcacaactgtttataatgttgtgagtcatttacggtgatgtttgtctgtaactcgttccccagttattgggctacagaccacactagaaaacaactgtccacatagcagctacaaacatttaaattaaaaaaa

SEQ ID NO: 51661 - DNA, 245 bp, Homo sapiens
ctttatttatacctcagcttccaaattttatccaaatgtaatcttaggcttaaaagtctaaaattggtcactctaaaatatgtgtaaattaaaactttttttaatttcttgtaaccataaggatattaacatactgtacaaagttagttataattacaatgattcattgtatataattaatcaaaaaagttgagtattatatattttgattactaaacacgaaaattaagttttttgcaaacaca

SEQ ID NO: 51662 - DNA, 403 bp, Homo sapiens
agtcccactgctggccagaagtggagtgaggcccctgcacacttgtgagggtctgcacttcttccccctagtatgtcacagccttaacaggtatgtctatgtggcagatgctggttattcaacattcattcagcagtgactgtgtgaagattaatcctatgtgggtcatgacctctggatgctgaaaggaaggtagggctacagagaaaaaaacatttctccatgatttcattacagatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggt

SEQ ID NO: 51663 - DNA, 457 bp, Homo sapiens
actcaatgtctgggtcgggtggacaggaacgtgctgtgggccccggccctttgctgtaagccttcgcaggtgccgttcattctgcccgggacgcgtctctggcctttctgaacgggtgttgcctcctcaggagcccagctgactcgtctcactgactccccctgcagccctctccaccatctggaattagctcccctgtatcttccactgcttcctcgacatctgactcactgcagtgggttctaagctgcaggaggacaagggccttattcctctgctcaccagtctgccctcagcagccaccgctggcactcagtgtgttttcaataatcgtgtgtggctgagatgcaggcgggaagcagaaggaagccttgtctgccaccatcaggccgtgttgtaagtgcaggtggccctgggctgcaagttttcaacggggacattaatcccaaagcgacgt

SEQ ID NO: 51664 - DNA, 1042 bp, Homo sapiens
  misc_feature (10)..(10): n is a, c, g, or t
  misc_feature (18)..(18): n is a, c, g, or t
  misc_feature (22)..(23): n is a, c, g, or t
attcggcacnggagagcnagcnnagcctcaaccgtcaaagctgtcagcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctgtggagtaaagagtgattttattgtcttcgtctacattcgtatttatattacattaagttttcttaatgacatggttttctttggtaaggaatacctactatgttccttttcatttcatcccatatacattcattcaaactttcaaaattgtagactgtcatcaaacagaactgcctccaactgtgccactttctcagcatattttcaattgaacttctaagatactgtaagtcgaaaattgtttaccgtctttgtgaagaggtttgagttcttaaaagagtcttagtgtcaccaagtttatgtactatttattagaatctgtaactatactttagtattgcatgactacatgattaatatacagaaaaaatagatttcagtgctatagggttatacattatagtagaattctggcttcgtccactgaccttaagaaatatatccagaaatctctttctgaaaataagatgtttatatcctatagcttagcatttaatgtgcaaaatacttttcaatagtctttttgtacttcatcttcaagggactcatttttgcctatctgccgggtgaatgactttgagactgctgatattctatgtccaagtaagtgagaatttaaaacagttttaatgtctggcttcgatctaccatttcacctttccatcagtaaatgtaaaaaaaaaa

SEQ ID NO: 51665 - DNA, 1844 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51666 - DNA, 1990 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51667 - DNA, 485 bp, Homo sapiens
tagcacatccatatagggcttgaactatctgatcagtttattcaaacaactctacaaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51668 - DNA, 2073 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51669 - DNA, 2615 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctgtggagtaaagagtgattttattgtcttcgtctacattcgtatttatattacattaagttttcttaatgacatggttttctttggtaaggaatacctactatgttccttttcatttcatcccatatacattcattcaaactttcaaaattgtagactgtcatcaaacagaactgcctccaactgtgccactttctcagcatattttcaattgaacttctaagatactgtaagtcgaaaattgtttaccgtctttgtgaagaggtttgagttcttaaaagagtcttagtgtcaccaagtttatgtactatttattagaatctgtaactatactttagtattgcatgactacatgattaatatacagaaaaaatagatttcagtgctatagggttatacattatagtagaattctggcttcgtccactgaccttaagaaatatatccagaaatctctttctgaaaataagatgtttatatcctatagcttagcatttaatgtgcaaaatacttttcaatagtctttttgtacttcatcttcaagggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51670 - DNA, 2219 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51671 - DNA, 2311 bp, Homo sapiens
  misc_feature (10)..(10): n is a, c, g, or t
  misc_feature (18)..(18): n is a, c, g, or t
  misc_feature (22)..(23): n is a, c, g, or t
attcggcacnggagagcnagcnnagcctcaaccgtcaaagctgtcagcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctgtggagtaaagagtgattttattgtcttcgtctacattcgtatttatattacattaagttttcttaatgacatggttttctttggtaaggaatacctactatgttccttttcatttcatcccatatacattcattcaaactttcaaaattgtagactgtcatcaaacagaactgcctccaactgtgccactttctcagcatattttcaattgaacttctaagatactgtaagtcgaaaattgtttaccgtctttgtgaagaggtttgagttcttaaaagagtcttagtgtcaccaagtttatgtactatttattagaatctgtaactatactttagtattgcatgactacatgattaatatacagaaaaaatagatttcagtgctatagggttatacattatagtagaattctggcttcgtccactgaccttaagaaatatatccagaaatctctttctgaaaataagatgtttatatcctatagcttagcatttaatgtgcaaaatacttttcaatagtctttttgtacttcatcttcaagggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51672 - DNA, 1278 bp, Homo sapiens
aagtagacaatttcttcatctcagttatttgaggacaggtatttcattttagcctttcaaaagtgaagagcagtattttaatctattttgctgtgttaagttctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttacta

SEQ ID NO: 51673 - DNA, 1527 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggaggtttgtattgtatggaattttgatgtctttattatataacagcttactatagttccttgtattttgctttcactttttgttatgttttcctaaagaaaaacagggtcattctacagtataatagatgtggcaatgtatgctatgaaaaagacacttttctttttaaacatagcagtagcaagacccaatttttaaccttctgatgaaattaataataactaacccatcacattgctgtgtatattttggaaaatagtacagtagctcccccttatccttaggagattcatttcaggacctccaggggatgcctgaaactgtggatagtaacaaaccttatatatatatatatgttttttcctttatgtacatacctatgataaagtttaatttaaaacttaggcacagtaagagattaacaa

SEQ ID NO: 51674 - DNA, 1346 bp, Homo sapiens
agcggggaatggggcgggacttccagtaggaggcggcaagtttgaaaagtgatgacggttgacgtttgctgatttttgactttgcttgtagctgctccccgaactcgccgtcttcctgtcggcggccggcactgtaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctgtggagtaaagagtgattttattgtcttcgtctacattcgtatttatattacattaagttttcttaatgacatggttttctttggtaaggaatacctactatgttccttttcatttcatcccatatacattcattcaaactttcaaaattgtagactgtcatcaaacagaactgcctccaactgtgccactttctcagcatattttcaattgaacttctaagatactgtaagtcgaaaattgtttaccgtctttgtgaagaggtttgagttcttaaaagagtcttagtgtcaccaagtttatgtactatttattagaatctgtaactatactttagtattgcatgactacatgattaatatacagaaaaaatagatttcagtgctatagggttatacattatagtagaattctggcttcgtccactgaccttaagaaatatatccagaaatctctttctgaaaataagatgtttatatcctatagcttagcatttaatgtgcaaaatacttttcaatagtctttttgtacttcatcttcaagggactcatttttgcctatctgccgggtgaatgactttgagactgctgatattctatgtccaagtaagtgagaatttaaaacagttttaatgtctggcttcgatctaccatttcacctttccatcagtaaatgtaaaaaaaaaa

SEQ ID NO: 51675 - DNA, 213 bp, Homo sapiens
cttttggcttaggagcatcatgaacagagaaagtttgaagaatatctgatctaacacatttaactcctttcttaccttaattttatgagacagcagtgagtggctaaatctaaatgttttgaatcattataaaacgtgtttgctttttcccttagatagtgctgcaagagggaaattcccaaaagaagtcaaatatttcagagaaaaccaagc

SEQ ID NO: 51676 - DNA, 286 bp, Homo sapiens
tcctttttgttattaccatcgtcgttattttttattattaactgtaaaaatagtgataaatccttttgctgaatatactgactctagcaatattccagtagttgatcttcattcgtagcagttttcttctttatctgaagctcaaaagagcttttttttctttttttgagatggtgtttcactcttggtgcccagactggagtgcaatggcacgatctcggctcaccacaacctccgcctcccaggttcaagtgattctcctgcctcagcctcccgagtagctggg

SEQ ID NO: 51677 - DNA, 861 bp, Homo sapiens
gtgcagtggcacaatcatatcccactgcagcttctcaacctcctaggcacaagtgattctcccacctctttcttgagtagctgggactacagaagtgtgaaccaccttgccgaactaattttttttttttttttggcggtagtgatggcatctcactttgttgctcaggctggtcttaaactcctggcctcaaacaatctgctggcctgtgcctcccaaagtagcttggattacaggtgtgagccgctgcacctggcattctctttttcctctttattactggttctgcatattccagctgccttaatctccctgaactctgttctgtatttcccatctctttcaatattatctctctacacatttttcccataggaaactccattattttccccagaaagcattaatgattcttgtcatcccatgcagaagggacacttgattcctggaatgttattattcactggtgctttatatcccctagactattcacgaaaaccttatgttctaaaatccatgctaaagaccaataaatcgtatgaaaacactaccatatgtttaaaatgtgttaagaaagaatacaaaccacaggaaattgatactgcttttgaataaggagagttgtgaggtaaacaatcagagattatttttcactgtataggcataccttggagctactgcaactttggttccagaccaccacaataaagcagatatcacagtaaggttaaggcacataagttgttcttcccagtgcacacaaaagatatgtttacactacactgtaacctattaagtgtgcaacagcattatgtctaaaaacaaaaatgtacataccctaattttaaaatactttttgca

SEQ ID NO: 51678 - DNA, 373 bp, Homo sapiens
gatcttagaggttctttacagaagttctgcctaccttttctccgttcatcttacacgaattaaattggatagcataaaaattcaagttaaaaaacataacattcggtccggtatggtggctcacacctgtaatcccaacactttgggaggccgaggcagacagatcacttgagctcaggagttcaaggccagcctgggcaacatggtgaaaccctgtctctacaaaaaatataaaaattagctgggtatgatggtgtgtgcctgtagtcccagctccttgggtagttgatgtgggagtattgtttgagcctcggaggtcgaggctgaggtgagccatgaccataccaccacactccagccagtctgggcacag

SEQ ID NO: 51679 - DNA, 345 bp, Homo sapiens
accatgatggtttacaaatgccatggtaacatcacgaagttaccctatatggtataaaaggggaagcatgaataatccaccccttgtttagcatatcatcaagaaataatcataaaaatgggcaacccatggccctcggggctgctctgtttatgaagtagccattctttactattttcctttcctaataaacttgccttcactttactctatggactcaccctgaattctttcttgtgtgacatccaagaaccctctcttggggtctggatcgagacccctttcctgtaacagcagggcctcatcccatcatttgaaagaccttaagagttagaactgagattt

SEQ ID NO: 51680 - DNA, 750 bp, Homo sapiens
ggtgctgtgacgaccagagcaaacacgccggatgttcctgtgtaggctgtgtaaggagtgaccggaagtagaaactgggtgctccagtggcgcaatcggttagcgcgcggtacttatatggcagtatgtgtgcgagtgatgccgaggttgtgagttcgagcctcacctggagcattgttttccaacccaaaatagcattacttgaagtgcctttccccctgtaatccgactccatcgtctttaacgtgtttggaattgtgtacacagtttattgttattggtttccttagcctttttagaaccaagcaacgccaattaccaacaaaatccgttgcgccgcagtgagttagctaccttctatctccactttgttctgcacgtcgatctcaggagaagccagctcccatgttaagaagttcaaatacctagagactgcgatggtttgcagaggctcaagctaaccacatggaaagacatggagagatattccttgccaaccctcaactactccaactattctaagacatcaaacctgtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaccttgagctttgaagatagtttgttatgcaataattgttgattctttcaccctgt

SEQ ID NO: 51681 - DNA, 408 bp, Homo sapiens
cagcccaggcagtaagaaaacatatcagcttccacttttacctttaaggagaagccagctcccatgttaagaagttcaaatacctagagactgcgatggtttgcagaggctcaagctaaccacatggaaagacatggagagatattccttgccaaccctcaactactccaactattctaagacatcaaacctgtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaccttgagctttgaagatagtttgttatgcaataattgttgattctttcaccctgt

SEQ ID NO: 51682 - DNA, 775 bp, Homo sapiens
cagcccaggcagtaagaaaacatatcagcttccacttttacctttaaggagaagccagctcccatgttaagaagttcaaatacctagagactgcgatggtttgcagaggctcaagctaaccacatggaaagacatggagagatattccttgccaaccctcaactactccaactattctaagacatcaaacctgtgagtgaaaaagccatctcataccttacaactctagcagatgccacatagtgtagagataagctctctctgtcattctctgtcaaaattgtaaaatcataagcaaataaataatcacagttgcttcaagttactacatttgagcatagtattttaagccactgcatttgagatggtttgttatacagcaatagataactaaaaaacaaagtcccttgatttagacttgtccactcaacttgcttggccaatggaatggggtagaagtgatggtgtgcttattcccagcctgggccttaaaaggctttgcctatttccacttgccttcttgtacttctgctattgtcataagaaaaacaaaccgcaggtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaccttgagctttgaagatagtttgttatgcaataattgttgattctttcaccctgt

SEQ ID NO: 51683 - DNA, 620 bp, Homo sapiens
ggcagagggagcccgctcaggcctcagccagcacagagaggggctcccacggtgcagctgcgggctgaagggctcctgaagcgcggccagagtgggctgaggccgaggaggcgccgagagccagcgaggggatgccagcaagctgtcacctctcagaaatacaggaagaacatcaataatgttcgaagttataaattgcggaggccagaagtcagaaaacaaggtgtctgcaggaccaacctctcctctggatgctctaggagaagccagctcccatgttaagaagttcaaatacctagagactgcgatggtttgcagaggctcaagctaaccacatggaaagacatggagagatattccttgccaaccctcaactactccaactattctaagacatcaaacctgtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaccttgagctttgaagatagtttgttatgcaataattgttgattctttcaccctgt

SEQ ID NO: 51684 - DNA, 987 bp, Homo sapiens
ggcagagggagcccgctcaggcctcagccagcacagagaggggctcccacggtgcagctgcgggctgaagggctcctgaagcgcggccagagtgggctgaggccgaggaggcgccgagagccagcgaggggatgccagcaagctgtcacctctcagaaatacaggaagaacatcaataatgttcgaagttataaattgcggaggccagaagtcagaaaacaaggtgtctgcaggaccaacctctcctctggatgctctaggagaagccagctcccatgttaagaagttcaaatacctagagactgcgatggtttgcagaggctcaagctaaccacatggaaagacatggagagatattccttgccaaccctcaactactccaactattctaagacatcaaacctgtgagtgaaaaagccatctcataccttacaactctagcagatgccacatagtgtagagataagctctctctgtcattctctgtcaaaattgtaaaatcataagcaaataaataatcacagttgcttcaagttactacatttgagcatagtattttaagccactgcatttgagatggtttgttatacagcaatagataactaaaaaacaaagtcccttgatttagacttgtccactcaacttgcttggccaatggaatggggtagaagtgatggtgtgcttattcccagcctgggccttaaaaggctttgcctatttccacttgccttcttgtacttctgctattgtcataagaaaaacaaaccgcaggtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaccttgagctttgaagatagtttgttatgcaataattgttgattctttcaccctgt

SEQ ID NO: 51685 - DNA, 1794 bp, Homo sapiens
accactcacacaaaccccctcctagactttggcttcagaaagcacagatgtgacccaggcttactaaagagacaactccacagccctgggaacacacccttgagccaaacttggttgaagactaggtcttccctggcaagttccggaagaatggacttactgacttttatcaactcttctcactgccaaggccaacagcatctgaggtatagctttttgggagtacctgctttcttgcctcctggaggatattttctgtcctgggcttcatggcccctctcttccctgttacacattgctgtgctcagagcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtctagagcaacctgccctgccccggtgtgcttggaccctttgcccagggaaccaggacatcagaaataatgttccttctgtggaaggacaacggggagctagggtagcaaagagcaataaattccaactctttatgaggtcaggagtcctttaaaaaagcctatgtcttggtctttaactgtccccttctgcaagatgtgactctatacacatggagacagattgaagaaagacttcacccatcttctaggaaataaaatcctgctcttgtcttctcccagtcactcccttatgcactgaaaggagaatttgactcccttgcacttcaaggccaggtgcctctccactagacagtcagacaaaggcaaataatggaggatagagagacaggtgttcattaggctggccatagggagaggaagggggtgacagcaggggaaaagaaactgtagtatcagttgtcacaagtagagctcggcccagctttccctcccttcccagccaccctagaattgagagtcccagtgcccctagtgtcgactttctatgtacatcctaggggtgagggagtgcggggcaatgggtaggatataaagcgtaaaggacaaattgccgcagtcttctaattgatgcttccaaactcaggaagggcttatccagtgtaaaatagccccaagcccagcaaccttctagagggctctggctgggcagatagcttttgtttttgagtctccagccctcagtcaaggaaaatataccatagctgctttcttgtcagtggcctttgagagaaagagaaaacaaatctagaattctgttcatctgatagaccgggggagctttgctatggtaggaggtttaggaagggcctttcacgcatagaaaccattgttgatattgccactcccctct

SEQ ID NO: 51686 - DNA, 165 bp, Homo sapiens
atttcatgtggaatttggggttggggggcaggctgggcaaggaacaaggcagaacactaagtaggccatggaagtggctgttctttcccccaccctgccacaccctgggagaaaaaactagactttggcttcagaaagcacagatgtgacccaggcttactaaag

SEQ ID NO: 51687 - DNA, 363 bp, Homo sapiens
tggcctccagggccagctggctgtacagccacctgcaagtctttgttcccggggttagccttgccaccctccttcaggactgcctagaattgtttcctgtcatcggggtagtaaatgtgttctcaggagcacgtgtatcttaaatatgttttaacgaatgtttacttagtttcttagaaacaaaacgtggtaaacacccagtcttattttctgggacacatgaagtgtgtttaagctgtcagctccaaaaaccctttccaagtcaaataacttaaaaaaaaaggttgtcagctaccactgcatcccagatgttagagtttatttctaaagctgttcttgggtgctgtttaatgttccagtgga

SEQ ID NO: 51688 - DNA, 933 bp, Homo sapiens
gcctccagagtagatggaattacaggtgcctgctaccatgcccacctaattttaaaaaatttttgtagagatagggtcttgctatgttgcccaggctggtctcaaactcctggcctcaagtgatcctacctcctttgcctcccaaagcactgggattataggcttgagccccctcgcccaacctgacacctttcttgaggcttgcagaagcaccaaggtgcctgcctgtgactggccgataacattttagcattttgatatgggcaggcatgctaactgagagtccagttctccagttagttcttgctttttgattggaatgttcctgcccattgctgttggaatgctcagaaagggccttggcctcctgaggacatcttcctcacatgcctgctctagcctgtgcctccccggggaaaaggagaggaccagggaagcctgtggacatcccttcctcccacaggctggaacacttttcagagtgggtgaatccactctcttttatctctctcctctttgtggcttacattattcctccccactctccttccctcattaacacacctttttgttgttgttgttgttgtcgtcgttgttgttgttgttccgggcaatatattgaaaacaaaggttactagacggcaaatcagacaacctgctttaacatctggaaatgactttgaacagagtaactcagtgtctccaggttctgctcacacatctgaatatgaaaataacaacatctgcccagcatatttttcatctgagctgctctgccccccaacctcgttgcggtgatcggttctccaacacattttgggtaactactatgtaaaagacacattgctagggaggaaatatcaatgtaaattgtggagcattatctaaatgtaaagtctcgttaccattaataaaacactcatctggaaacta

SEQ ID NO: 51689 - DNA, 429 bp, Homo sapiens
tttcctcacttttttgcctgagaaaatcctactattacaatatttatgatagatgtgagatgtagacttatctaaacttctacatttttccattttcccctgaggctaatgtgaataaaacaatgtaaataatagattacctctcctttgaaaatggaccagtgaggcaattccttggtaataactcaacacatattctactgatactgaatgttttatgtaagaccttgcaaaaatgtgtctgtttatggtcttggctacctttcatctcaatggggatgaaaaattatggactatgactttatatgtaaatcatcatgatgctatcattctttaatattcaaaaatggtttcttatattgttagggaggttgatccctttaagcataatttttaattgaaactacatttggggaatttgtagtttat

SEQ ID NO: 51690 - DNA, 2460 bp, Homo sapiens
  misc_feature (2448)..(2448): n is a, c, g, or t
tacactaaacttaaaacatttaaagtgatgtggcttctcttagagctcaagtgtgctaataattttaattgtcgttccctcatgtcattgctcttatataataatactatatttattgtaataaattaaattagaacttgcaataattttatcaagaacaaagtctaaatgatttctccttcaaatttgagatgcaattaaatgtatgaaatcctaatatcagaagttaagatcttttgacataaatatatcaagaaaatccttcaatccctcacatgtcaaataagtaaactaaggttaagaattcagttaagtaaaaagattggttaagaatttatttccttgggcttttcaaaataaaatccctttataattgcatggaaaatgttttccaatttattctggcttctggggactctgaaattttacagttcagtagatgtttctgttggtttctttttgaagaagagtggaattttagtttctgaaatataaagtgggagcactggatcctaatttcagtgtgttcatttatgcgtgttcctgagtctaaatttatttttttaaaaaataaaggtaattatccctgatctgcccatctgagaagatgttgtatagggcaaacatgaaaacatatgtgaaaggatatgaaaatgtgtaaacttctagataagcatgtaacagatacttaggcattttttcttataaaatcaatttcaacacagatgacataaattatcaaattactttgatttcattgagttttatagctttccccctctagtataaaagtgctgattactcatgatattcataggtgttttcatagccacagtatatcaaaagaagattgactagaatataaaacacccacactaataatagtaccaaacagacaattgatttgaaaacattgtttctttcttctgatcatcacattggtgtcagtttcattaattttataatgtctcctctagtggacaagagactggaaatggttcttagagataggatcttactccttcagatgattttataatttgtttactaaaatcttcttttatcttattaaagcttaggctcttggattgtgtgaaaaaaatgaggttctttcaatggctatttttatattgacttggtaaatcatttcaattttaaatattgtatgacaatggcctcatatttttcaatcataacaatcataggaaataatatattggatatttgcatatttttatgatagtatatctattactaataactgatacaaaaaatagatatttgtgcttttaataaagtaatatgagaagtaataatgacattctataaattgtcccatattctaatagttatgcataatgctttaagacttgtatactttgctttcttacatagtttttagttatcttcagaagtataaataatctattagtttataattcattgaaatatagttaaatcctctttaaatatttattttatttatttgtttaaacatgtggactttatttagaaaaattatatgattttgttactcttaatagagtttaagtacactttgtgatctgagtataattgtgcatattgaatctctggacttaaatactatggatattccagtatctcaaaattaagttgaaagttttattacagaataatgtagtattcagttctcttaagaattaaaaatcacttcgacagtcagttaagaagaaacacgacaaaaatatttttaggtaattaaataagatttgtctactaaccatcaagaataaattttaacacagttagtaaacattttattaagtataaagttggagcctgttgatcataaatgtatcagagttcactataataaaatattcaactttgccttaaattaaggaatgtttcaaaattcataaatgggctaatttgtgtccacttgaagagtttctttctttgcttttgatgctattctgtaaacaatggttccctacataattgtaatagtgttttacgttgtcacaacaccaggcaaaacccaagtgctattgcaagctttgtaaatctatcactgtcctcatccaccttatcagattcttctcttctttgtgtatgcactggtctttttaaaatctgtgatgtgtactgattgtagatttattccatactttcaagtgaatgctaataatatctaagagtaatgatttccctgagaaaactttatccatttgaatataatgaatgttcatatttcttggtgtaccaaagttataaaaaaagacagaaacaattttacatttaaaatcaatgaagtaaaacagaagatttagttaacacaattgtatttaattatttgcttaatatgtatttttaaaataacttatttgcatatgttgactaagtcatgctgttgaccctcaataaatgttaaattatgataatattgtcgacgcggccgcgaanttagtagtagta

SEQ ID NO: 51691 - DNA, 2202 bp, Homo sapiens
  misc_feature (2093)..(2093): n is a, c, g, or t
  misc_feature (2099)..(2099): n is a, c, g, or t
  misc_feature (2102)..(2102): n is a, c, g, or t
  misc_feature (2109)..(2109): n is a, c, g, or t
  misc_feature (2113)..(2113): n is a, c, g, or t
  misc_feature (2116)..(2116): n is a, c, g, or t
  misc_feature (2119)..(2120): n is a, c, g, or t
  misc_feature (2125)..(2125): n is a, c, g, or t
  misc_feature (2134)..(2134): n is a, c, g, or t
  misc_feature (2141)..(2141): n is a, c, g, or t
  misc_feature (2147)..(2147): n is a, c, g, or t
  misc_feature (2150)..(2150): n is a, c, g, or t
  misc_feature (2152)..(2153): n is a, c, g, or t
  misc_feature (2165)..(2165): n is a, c, g, or t
tacactaaacttaaaacatttaaagtgatgtggcttctcttagagctcaagtgtgctaataattttaattgtcgttccctcatgtcattgctcttatataataatactatatttattgtaataaattaaattagaacttgcaataattttatcaagaacaaagtctaaatgatttctccttcaaatttgagatgcaattaaatgtatgaaatcctaatatcagaagttaagatcttttgacataaatatatcaagaaaatccttcaatccctcacatgtcaaataagtaaactaaggttaagaattcagttaagtaaaaagattggttaagaatttatttccttgggcttttcaaaataaaatccctttataattgcatggaaaatgttttccaatttattctggcttctggggactctgaaattttacagttcagtagatgtttctgttggtttctttttgaagaagagtggaattttagtttctgaaatataaagtgggagcactggatcctaatttcagtgtgttcatttatgcgtgttcctgagtctaaatttatttttttaaaaaataaaggtaattatccctgatctgcccatctgagaagatgttgtatagggcaaacatgaaaacatatgtgaaaggatatgaaaatgtgtaaacttctagataagcatgtaacagatacttaggcattttttcttataaaatcaatttcaacacagatgacataaattatcaaattactttgatttcattgagttttatagctttccccctctagtataaaagtgctgattactcatgatattcataggtgttttcatagccacagtatatcaaaagaagattgactagaatataaaacacccacactaataatagtaccaaacagacaattgatttgaaaacattgtttctttcttctgatcatcacattggtgtcagtttcattaattttataatgtctcctctagtggacaagagactggaaatggttcttagagataggatcttactccttcagatgattttataatttgtttactaaaatcttcttttatcttattaaagcttaggctcttggattgtgtgaaaaaaatgaggttctttcaatggctatttttatattgacttggtaaatcatttcaattttaaatattgtatgacaatggcctcatatttttcaatcataacaatcataggaaataatatattggatatttgcatatttttatgatagtatatctattactaataactgatacaaaaaatagatatttgtgcttttaataaagtaatatgagaagtaataatgacattctataaattgtcccatattctaatagttatgcataatgctttaagacttgtatactttgctttcttacatagtttttagttatcttcagaagtataaataatctattagtttataattcattgaaatatagttaaatcctctttaaatatttattttatttatttgtttaaacatgtggactttatttagaaaaattatatgattttgttactcttaatagagtttaagtacactttgtgatctgagtataattgtgcatattgaatctctggacttaaatactatggatattccagtatctcaaaattaagttgaaagttttattacagaataatgtagtattcagttctcttaagaattaaaaatcacttcgacagtcagttaagaagaaacacgacaaaaatatttttaggtaattaaataagatttgtctactaaccatcaagaataaattttaacacagttagtaaacattttattaagtataaagttggagcctgttgatcataaatgtatcagagttcactataataaaatattcaactttgccttaaattaaggaatgtttcaaaattcataaatgggctaatttgtgtccacttgaagagtttctttctttgcttttgatgctattctgtaaacaatggttccctacataattgtaatagtgttttacgttgtcacaacaccaggcaaaacccaagtgctattgcaagctttgtaaatctatcactgtcctcatccaccttatcagattcttctcttctgnttgccnggntttaaancggnggntcnntggcntttcccatncggaggnaaattnaananntccggaaaatcngaaaaagggtttggggcataaaaaacattattggaaa

SEQ ID NO: 51692 - DNA, 2165 bp, Homo sapiens
cgcatagacagcccggttaatcggacgaggcaggactgcgccgcgtcttcctcaaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51693 - DNA, 2680 bp, Homo sapiens
gctcgcaggcgggggtttccatggtgatggtcaacaagcctcaactgcctctgctacaactgccaagttccccgcgtcccaccctcctctaggtgctccaagggaccaccggggtgcctgatacgagagcgggagtgtagagactcggaggccgaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51694 - DNA, 2654 bp, Homo sapiens
acgccggacgcagaaactccgccctgccgcggtccttgcgtccttccggctccgtcgtggaagcaggactgcgccgcgtcttcctcaaggtggggttcggggggccaccgaatcgctgtcacgccggcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51695 - DNA, 2239 bp, Homo sapiens
acgccggacgcagaaactccgccctgccgcggtccttgcgtccttccggctccgtcgtggaagcaggactgcgccgcgtcttcctcaaggtggggttcggggggccaccgaatcgctgtcacgccggcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51696 - DNA, 983 bp, Homo sapiens
  misc_feature (871)..(871): n is a, c, g, or t
gacataaggcaggacgaggccgcgttgttaatcggcaccgaggcttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgcattctatatgtggaatgggagctgataaattttgtatggatncttgggggaccgcacgtaccgtcattcggccatctcccaaaagcttcgaccaacaaacggggccatcccggcgccgcctttagccaccatgccggcaccgaccagacgcgac

SEQ ID NO: 51697 - DNA, 935 bp, Homo sapiens
  misc_feature (872)..(872): n is a, c, g, or t
  misc_feature (875)..(875): n is a, c, g, or t
  misc_feature (882)..(882): n is a, c, g, or t
  misc_feature (884)..(884): n is a, c, g, or t
  misc_feature (887)..(887): n is a, c, g, or t
  misc_feature (893)..(893): n is a, c, g, or t
ccccgctgcgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggctgnccncgctccncnggnggaaangggcacccgggtacatggccgtgggcccaagcaaatactcgc

SEQ ID NO: 51698 - DNA, 318 bp, Homo sapiens
tgagaattgagacacaatactaatactgtaggaattggtgaggccttgacttaacctaaaggattttaaatgaaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51699 - DNA, 764 bp, Homo sapiens
ccccgctgcgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggtaagtctagagcatgaaagtccgcgggcccggccgggtggactttggtttgagagtggaactaagtgagtaatgggggcggcgcggccagacgcgctcccagcctcctggcgagagtgctgcccggtttcccgggggcacgggagtgtgtctaggaggggaggccaggatccttcctcgagtcctgtcctgaacaaaagaaaacgaggtgggtggtggctaagaatctccatttccaaaaagcgctcccgaacgagctcttcgcagtgatacaggttggacgggattaacacttgccttcaggcagagccaatcaagataaatagggcgcgccggagtcctaccagttcggctatctgcagagtaaacagggccgttca

SEQ ID NO: 51700 - DNA, 2608 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51701 - DNA, 2613 bp, Homo sapiens
cgaggtacgaggccgggtgttactcggcagaggggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51702 - DNA, 2613 bp, Homo sapiens
acgccggacgcagaaactccgccctgccgcggtccttgcgtccttccggctccgtcgtggaagcaggactgcgccgcgtcttcctcaaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51703 - DNA, 2626 bp, Homo sapiens
ccgtgacccacgtccggctgccggtcttggatcacgaggcctccgcttcccggactccggaccccgcgcctcctcggggccgacgggccagtccctggcgtggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51704 - DNA, 2773 bp, Homo sapiens
ccccgctgcgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51705 - DNA, 2635 bp, Homo sapiens
  misc_feature (7)..(7): n is a, c, g, or t
  misc_feature (69)..(69): n is a, c, g, or t
attacgntgcgagaagacgacagaagggagacacaagcgcagaggtcatggcggatggccccaggtgtnaagcgcccagaaagcaggcgaacccgcggcgcccaataaacggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51706 - DNA, 2554 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaacatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51707 - DNA, 2392 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgattcaaacactagttcaatatctctgtcactctctctctctctctctctctcactctagctctctc

SEQ ID NO: 51708 - DNA, 2534 bp, Homo sapiens
ctagcaggaccttactggtatcccaccccacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51709 - DNA, 2043 bp, Homo sapiens
tctcgggccctgtattggtctcctgctcctagaggttgagaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51710 - DNA, 2225 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaaaaaaaaaaacggcacgagcggcacgagcggca

SEQ ID NO: 51711 - DNA, 2280 bp, Homo sapiens
  misc_feature (2239)..(2239): n is a, c, g, or t
  misc_feature (2245)..(2245): n is a, c, g, or t
  misc_feature (2276)..(2276): n is a, c, g, or t
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaaaaaaaaaaaaaaaaaaaaaaaaaaaaaaaaaaaaaaaaaaaaaaanaaaaanaaaaaaaaaaaaagagaaaaaaaaaaaaaanagaa

SEQ ID NO: 51712 - DNA, 2423 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaaaaaaaaaaactaatttttacatttttcaacatataaataataacaaaaataaaatttattaaaaaaaaaaatgtataaaaaaccttgtggcccgcttggcccaagtgactttttaacttggggaagttttatgatatggggccgaatttggggttaattgggcaattcgcccttttggggagccgttatacaatttactgggcccgggttttacggttcgcttgggtttg

SEQ ID NO: 51713 - DNA, 2206 bp, Homo sapiens
gctcgcaggcgggggtttccatggtgatggtcaacaagcctcaactgcctctgctacaactgccaagttccccgcgtcccaccctcctctaggtgctccaagggaccaccggggtgcctgatacgagagcgggagtgtagagactcggaggccgaggttgagaacaaaaacatgcacctggagtttccccggagccctctgcgtggttgagcttcggtggaatttcggggctcttggctgccagccgcgcttgcctggtagcaacagaaaccagtcctgctcgcctccgtgccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51714 - DNA, 2004 bp, Homo sapiens
cgaggtacgaggccgggtgttactcggcagaggggctgcgccgcgtgtcctcggagcgcggtccctgtattggtctcctgctcctagagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51715 - DNA, 2556 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51716 - DNA, 2484 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccgtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51717 - DNA, 2563 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttggacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51718 - DNA, 2139 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttttctttgggccgtggaatccctctgggggttacgcgcaagtgacctggtccttttggtc

SEQ ID NO: 51719 - DNA, 2190 bp, Homo sapiens
  misc_feature (2078)..(2078): n is a, c, g, or t
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgcattctatatgtggaatgggagctgataaattttgtatggatncttgggggaccgcacgtaccgtcattcggccatctcccaaaagcttcgaccaacaaacggggccatcccggcgccgcctttagccaccatgccggcaccgaccagacgcgac

SEQ ID NO: 51720 - DNA, 1721 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttca

SEQ ID NO: 51721 - DNA, 2042 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagtgacaggtgctaaagttgaacgagctgatggatatgaaccccagtccagaatctgtttaaagttcagacttcaatagtggcaataaaagtgctattgaacttctaaactaggggtccgagctcgattcgtatctgtctctc

SEQ ID NO: 51722 - DNA, 1867 bp, Homo sapiens
tggctagtgggcgggggtatcggacgacccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51723 - DNA, 1809 bp, Homo sapiens
ccgtggtgtgtctgtgtgtgtgagagagagagagagagagagacagagaaagaaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51724 - DNA, 1504 bp, Homo sapiens
ccgtgacccacgtccggctgccggtcttggatcacgaggcctccgcttcccggactccggaccccgcgcctcctcggggccgacgggccagtccctggcgtggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51725 - DNA, 877 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaaagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 51726 - DNA, 1006 bp, Homo sapiens
acagatacgaccgagctgaacccctagttttagaagtttcaatagtaatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51727 - DNA, 1090 bp, Homo sapiens
  misc_feature (8)..(8): n is a, c, g, or t
  misc_feature (13)..(13): n is a, c, g, or t
  misc_feature (45)..(45): n is a, c, g, or t
  misc_feature (51)..(51): n is a, c, g, or t
  misc_feature (80)..(80): n is a, c, g, or t
  misc_feature (105)..(105): n is a, c, g, or t
gggctttnggggnggccccagggggaaggaaaaaggggggccttncccaanttttttggggaaaatttgggacccccaanaatttttccggcaaccccccaaccnttaagggccagttaaaaaaaggggtaatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51728 - DNA, 911 bp, Homo sapiens
tctcggccctgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagtttttccaagtacccggctaaggtgccagggtttactcaagaacagcatacattacgtc

SEQ ID NO: 51729 - DNA, 903 bp, Homo sapiens
acagatacgaccgagctgaacccctagttttagaagtttcaatagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51730 - DNA, 854 bp, Homo sapiens
acagatacgaccgagctgaacccctagttttagaagtttcaatagattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51731 - DNA, 1016 bp, Homo sapiens
cgcatagacagcccggttaatcggacgaggcaggactgcgccgcgtcttcctcaaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51732 - DNA, 867 bp, Homo sapiens
caatagcctgtgatactgagaaaataaaatctgatatcacgctctgctcaatgacagcatcagcattcactacgccatagagattctactactaggaggtaggaactcgatgttcgatgtcgtgtctcatagctcacatcagagtgaactcgctgtccggaagtgcagtcagggcgtagtcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51733 - DNA, 604 bp, Homo sapiens
cagcggaacaagcaagagcttcaccttatttagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51734 - DNA, 937 bp, Homo sapiens
cgttgtggatatagttgtttcccttatattcgagagttcgctgtgtgttggacgtttctgttttagtcctcctgtttttgttctatagtttgttgtatcttctttgtgtttttttttttgttttgttgtgttgttctcattcgcggttgtaatgtctctttctgctgtgtgtgccctctcttgggtttgggcttcttttctttttggtccttcgcttggttttttttgcgagcctctgttctttctttttactggttctttttctgcttttcttgtttacttgccttcggcccccccttttggccccctctttcccgatttttgttctcttttttttcgtttcttttggtgctcctctctttttttttctttctttgtttttttttttttttgttttttgttgttttttttttttttttttttttaattgtcttttttttttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttaaaattggtc

SEQ ID NO: 51735 - DNA, 370 bp, Homo sapiens
cgaggtacgaggccgggtgttactcggcagaggggctgcgccgcgtgtcctcggagcgcggtccctgtattggtctcctgctcctagagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggattcagtgaatgagaccgtagaaaggggggtaaccgaagctcga

SEQ ID NO: 51736 - DNA, 351 bp, Homo sapiens
gcaaatgggaagaagtcagttcacttcctgagtgtctaaatagcccacattcattgggccactttgcacattgctaggccctgtgctcggtgccccatgcgtatcaccacatttaacgagacactcccgttagaaaccacacttcgcagcaaaggaagccctcactcagagggtctaagacacttgcctaagcccacgtagcagggacatgtatggattgaaattcaaatccatcaagtggatagatttgaatttgaagtcatcttcctcctgtgtgaagccaagacggcctctggtcccttctgaggctcacttctcggcactccattactcatcttgcactgtccctcc

SEQ ID NO: 51737 - DNA, 183 bp, Homo sapiens
gaggaatgttagtggaaaagcaaggttttctatattaattatttaaaaaatgtctctgagactagtattaacctggaaaacttactgattatcgtaagtactatttctctctctctctttagttgccccttataaattccaggtttaacaactttttaaaatgttcttatgccatgaacatct

SEQ ID NO: 51738 - DNA, 487 bp, Homo sapiens
caaaagttgtaagagctgttttttgagttgggtggtgacttatgccttgttctagggttaatctaacagctctgtaaaccagatgttttgacctttggttgatagattgagcagcttcttcaggaagggaaagtcattctgtctttcagctttcctacattttctctgcagctccttactgggtgcacaaggaaaccaagtgagtccctggctttctgtcacaggccaccattctgcaatggttaggatatggttgctatacaagtgttatctctttaggatatcagtagagtggttttctcacaaaccctactgctgtggatatgtcaaactcagattttagtgctagagtttctattataagctttcagatttagtaacattaactctgaatctattaatacatgggaccttttttctcttgaagagaaagttagagtctctcagaaatagtcaactgaactttaaccctatccccttccaataa

SEQ ID NO: 51739 - DNA, 248 bp, Homo sapiens
cctgggcaacacagtgagaccctgtctctaaaaaaaaacaaaaattaagaaattagccaggcgttgtggcatgtgcctgtagtcctaactacttgagaggctgaggtgggaagatcacttgagcctaggaggttgaggctgcagtgagctgtgatcacaccactgcactccagcctcagtgacagagtggggtcaggaggaggggtcaggaagatctatgtataaagataggaaaattacctgcacag

SEQ ID NO: 51740 - DNA, 300 bp, Homo sapiens
cttaatcttaagaggttgtagaaggacagagatctatcttctgtcactgcttcatgctgaacaggggccatcatccctacctgctctggaggcatagaaatgtcttcgtacctgatcgaatgacttatagggactccatcttttctgcagtggcacaggctggaacactggactaattatttttctctgaaactgttgtagcctggaagacataaacttgaaccgtccgaacacctgatgaatataacaaatatttttaaaatcaaatagcacctagtgataattcataaaatacttaag

SEQ ID NO: 51741 - DNA, 180 bp, Homo sapiens
ttgccccgctgaattgtggctgtgtgtgtgaggacctgctagacagcgagctcagagcaaacagggactggtttggtggatgtgcatgccttggacctgactagcaagtcaatttttcctaatgaatgagtcccagacatcatcagtttagtaaaggtctgaggcactgaatcaatcact

SEQ ID NO: 51742 - DNA, 250 bp, Homo sapiens
cttggcttttccctacgcctgagaccctgtcactacttcgtctgaagtacagaggctctaataagactctcctgcatccttctttcttcctggaaattacattagacagtttccccaatgcatgtcccatggaacaccagtccctcctgccgttttctaggaaccaggcaagaaggagttctgtgaatgagcttccaccaagaattcctgaaacaggcttccacagagcccctcagggtaaacactggct

SEQ ID NO: 51743 - DNA, 194 bp, Homo sapiens
ataaaaactacactcatctaacatggcctaccagggcctgcctgatctcttcctcctgcctctttccctcatggttacacattgaagccaaactggccttctttctaattcctttcgaagaattgaaggctttaggaccttggtacatgctgttctcttctcttggaaaactccctcactctgtttgggtaact

SEQ ID NO: 51744 - DNA, 340 bp, Homo sapiens
caagaagcagctctgaaaatgcaaagtacctgtggtttgaattccctcaggttaatatcctgtattctttctaggtctcagatctctggggttatgctgttttgcatgatttatatcatggtcttgagggaactgaaccaccaaaggccccctcctcctgcactccccctttgattctagcagcagaaggcaacattgctaaccagggcagttaacaggccaaatccttgtcttttgggaataggatttggaaggggaaggggaatcctagagcctgcaggctgattataactacagtcagtactgtgtcccaccgaatatacagaacatgcggataaac

SEQ ID NO: 51745 - DNA, 1262 bp, Homo sapiens
tatttttaacatacttggttgggtttgagagaaatctgtggacgtaattttttgtttgtgtcaagctctatgactcatgcagtgattggtcccatgatcatggcctattagtgaaaacctccaaaggtcaggtggccaaggtgttcccacattttttctatataacttgtttcctaatagtctgcctttctacctatgattaaaaataatttttatatacaacattatttacatttcaaacatctctacgaagtcatgccattttaaggagatgaaaacagccacagagttgagtgacttgctccaaatcacataactaagccaggactagaatcccagactttcagattttctctgccctgggttataatctcttgtttttcagtgatagacctgagtcagtctgagatgcttatttatgaaacagtataccatgaatatttattatctttcttgggcatgcttttctacacattttgaatactttcaacagggattacccaagaatgcaacatctacctgtaataaatggggagaaaattagttgcctgagagaacagaatattaagcacacaaatactttccaacacagggttgtaaattgtgctcctcattttaaggtgctgtacgtgcatgtttaaggaattattaatcagtgtattctgcttgctttctgtattaaccagttccagaggatagccttagaaatgagtgtattttgaatcttaaagtttctttatatgcggcacagtgtataatgtcgtaagttaagaaaaatctgttatctttcaaagaagttacgtagtttcaaaaatgaggttttgtaatcagtgttgaaaaaactctgaactatgacttactttgaggatgatccttgagctcatgtatttgatctgctcaaaagtaataactaaagctgagttaaacagttgttatttatttcagggttctgatttttcccagctggctacacaaatggcctgtctgaatcctagtttagtgtgttttccacgatgggcagaagtcagaacattatctgcttctgtgaggatcataataaaaagttagttttaattacgagtttaaaggaattttagatttttttcagatgcagtattttaaaggaacaaaactcctgtgttgccttttgttgttgttgttgttgttgttgtttcctagagacaggttcttgatctgtcactcaggttagagtgcagtgatgtgttcatagctcactgtaaccttgaactcataagctcaag

SEQ ID NO: 51746 - DNA, 187 bp, Homo sapiens
attttttttttattactagtaggtatattgttgtactcaggctgagagtaacccggaattttacatacagctctggttaatcatttcaaataatctatatggaagattttcttaattcactttttaatgtctttgagtgtactctaaaccattattggtgtgtagtattttagcttgaagtaatcac

SEQ ID NO: 51747 - DNA, 169 bp, Homo sapiens
aaaagattagctaggcgtggtatggtggtgcacacctgtggtcccagctactagaggagctgagggggtaagatggatggctggagccggggaggttgaggctctggtgagctatgatcatgccactgtgctgcagctcagcgggtgacaaagccagaccctgtctctg

SEQ ID NO: 51748 - DNA, 319 bp, Homo sapiens
ctcactgcaacctctgcctccccggttcaagcaattctcctgcctcagcctcccgagcagctgggattacaggcatgtgccactacacccggctaattttttgtatttttagtagagacggggtttcaccatgttggccaggctggtctcaaactcttgaccccaggtgatctgcccaccttggccttccaaagtgttgggattacaggcacgagccaccactgtgcccagccagaactggatttttaacttgatttaaagaatttaaataggcccatgcagctagtggctactgtattggacaatgtctcttcagttg

SEQ ID NO: 51749 - DNA, 206 bp, Homo sapiens
cttgcatacaggtggcaagttattacattatttcttcctcctgtctacctgcagttggttttatgaggggcgttagtacacttcccaaagggcttgcccgcagggtgagaggtgcacattgaactccctcaccaggcagatgggaagtgtggccatgagagagagcttcaggggccctgggtttatgacatcgctgggccaggaat

SEQ ID NO: 51750 - DNA, 786 bp, Homo sapiens
taagagaattcatactggagagaaaccctacacgtgcgaagaatgtggcaaagcttttaaccaatcctcaactcttatattacacaagagaatccattctgggcaaaaaccttacaaatgtgaagaatgtggcaaagcctttacacggtccacaacactgaacgaacataagaaaattcatactggcgagaaaccctacaaatgtgaagaatgtggcaaagctttcatatggtccgcaagcctgaatgaacataagaatattcatactggagagaaaccctacaaatgtaaagaatgtggcaaagcttttaaccaatcctcaggccttattatacacaggagcattcattctgaacaaaaactttacaaatgtgaagaatgtggcaaagcctttactcggtccacagccctgaatgaacataagaaaattcattctggagagaaaccctacaaatgcaaagaatgtggcaaagcctataacttatcctcaacccttactaaacataagagaattcatactggagagaaacccttcacatgtgaagaatgtggcaaagccttcaattggtcctcatcccttactaaacataagataattcatactggagagaaatcctacaaatgtgaagaatgtggcaaagcttttaatcggccctcaacccttactgtacacaagcgaattcatactggcaaggaacatagttgaatgacatttctagtaatctctaattccagtgtctttacacagcaaataaattggagaatattgctcccatataaaaaaaa

SEQ ID NO: 51751 - DNA, 228 bp, Homo sapiens
cttgtctcaaactcttgagctcaagcaatcctcccactcggcttcccaaagggctaagattgcaggtgtgagtcactgcacccggcctaaattgcatcttgccagtagactgaagctcagattctgtattctacacattttaaaactcttcagtttgaagtattctttatagataccacaatacaattacttttgtaaccaaaaataataattccctcttgaaaaaaa

SEQ ID NO: 51752 - DNA, 180 bp, Homo sapiens
tctctgttctactattgatgggcggttaagaatattttgagatatgacttacatttttaggggaaaaattcgttgttatgtaaatccataattaaacagcattgaataggtaggtagattctactgtattagataattgcatcttattttgcagttacctgttttttatatattaaacat

SEQ ID NO: 51753 - DNA, 284 bp, Homo sapiens
caaagaagtagctagacgctgtggcatgtacctgtagttctagctgctcaggaggctgagtcagaatcacttcagcccaggagtttgaggctgctgtaaaccacagtgatgccactacactccagcctgggcaacaggatgacccccattcaagaaaaatgatagaggtttagtatttgtaaagtactctatgggaaaatagtattaagaatttccaggccaggcacagtggctcatgcatgtaatcccagcactttgggaggccaaggtgagtggatcacgag

SEQ ID NO: 51754 - DNA, 435 bp, Homo sapiens
agaagctgagggaaatgcttgtacttttctcttttccccatcttgagatggttcttctgggttgtgaaataccttagaaaagattgtattttcagcaatttagtctagtggagacgtagcagaatgctagggtcagccagatctgggtataattgtaactctcgtgatttgatatcttggtaatttagactagagccagagcagtttttaaagagaatcttttctgatcattttaagcagcatgataaattctaagtaaacataaattttgaataattacagagtgggcatgagctcttcctttctttgttcctctacatgcaagaaactggatgccaagcccaacctctggatgaagtgggaatctgtaaggatgacgtacctaagtctaaatcagacaaaaagacacacacaaaatacatttatacattttta

SEQ ID NO: 51755 - DNA, 613 bp, Homo sapiens
catctcccctcctccaacccccccctccccccaccacacacacacgaccagtagctactattttctgtttctgtacattttataaatggaatctctttcgtgtctagcttctctcaattttatgcttgtgagattaatccatgttgttatgtgtatttgttatctgtattatttttaaattcaaactaaaaaaatagtccctttatttgaaaactaaagcataaagtgccaacgaattctacaactcctgctgtgggaaaaaaagcagtttgtcaccctgccctcattctctatttgcttttaatgcagtggcaataatttaaagttttcagctgacttgcactatttacctccaggtctcttaagatttttagctttcacatacttctcttccctctatctcctaccctacacacttcacaaactctgtaccattccaatggctttatctttattttcatcagaaattcagcatttttcagccaggtgcggtgtctcacgcctgtaatcccagcactttgggaggctgaggtgggcagatcacttgaggtcaggagttcaagaccggcctgaccaacatggtgaaaccaggtctctaatacttaaaaaaaaa

SEQ ID NO: 51756 - DNA, 276 bp, Homo sapiens
tgggcagaagtattgtgagtgagaaccaaattccttactagtcctaccacctgagcttcaaggattgtggatatccagtggggaggagaactgatggggactggggcgagaaggtcagatctgaagaaactccaggggcatgagcagacccagcatccatggacaacgcagtatccactcacatgagcctgtgcaccaccggtgcatcggggctgcactggttgtcttgtcctttggcatccagtgaggacttcctaggagggctgttggcatttt

SEQ ID NO: 51757 - DNA, 451 bp, Homo sapiens
gagtagaaaagatataccatgctaacacagaagaaagcgggaagctgtattattacacaaagtaaacttcagaacaaggaatgttagtagagttagaaagagagactgtgtaacagataaaggagttgattccttaggaacatagaacagtcttacatgtttatgtatctaatatcagagctgtttattctctagccataatggattaaactagaaatcagtaacagaggtatccagaaaatcctcaaatgttcagaaattaaataacttcatacttacaaataatccacaggtcagagaggaagtttcaagggaaataaaaacattttgggccgggcgcagtggctcacgcctgtaatcccagcactttagggggccgaggtgggcagatcacaagataaggagatcgagaccatcctggctaacacggtgaaactctgtctcgactaaa

SEQ ID NO: 51758 - DNA, 299 bp, Homo sapiens
cctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaag

SEQ ID NO: 51759 - DNA, 166 bp, Homo sapiens
catagcaagacccaatctctaccaaaaaattaaaaattagtcaggtgtggtggtgcacgcctgtggtccgtgtggccccagctactcaggaggctgaggcggggagggagggatcacttgagcccgaaaggttgaggctgctgtgagttatgatggcaccaccaca

SEQ ID NO: 51760 - DNA, 559 bp, Homo sapiens
ttgtccttggaggtttacttttctcctctgtgtcctcccatgcataaagctgagagagttaactttacaaagaagtaatcaaatagatgaaaaataccccctaccaaggtagcccatgtaagaactaaggaaccaccaaaatcacgcatatcagttcaggagagaaagttatcatttagctgtttgacacgttgaatcttttccaaaagcaatgaagctagctcttggagtgcagaagctctcttgtgctgggccacttccctggtctcaaccaagagagagttggctccactaaagcagaaattctcagtcccatccacaatcactgacttcttctaacaagtcttctgaaaatctctttactaatttctgaaatgaaattcagaaataatataacctacctatgcatataatttttaaaatcagtgtaaggtctaaattgaaacataaagtagaaataatttacactaatacatatataacattaataatgaataattattatattaatagccttacaataaataaattggtttttaaatacagtatattcaactaa

SEQ ID NO: 51761 - DNA, 176 bp, Homo sapiens
catttccctaatattattaaacacctttttataaatttattggccatttgatttgggaatctcttctcattttaaaaattggattgtctgtctttttcttattgatttgtaagcattatttatatattttggatattagtcttttgtcaatataaatacacatatatatagaaaat

SEQ ID NO: 51762 - DNA, 843 bp, Homo sapiens
ctaaatggctgtacttttattttattttattttttttgagatggagtcactctgcactccagcctgggcgacaccgtgagactccatctaaaatagaagaaaaggtttctcttcatggacattgtttgcatctacatgtgacacttaggaatgatctgtttagtctcaatcactcactcctggatctgcctgtctctctctgagataacaaaggccttaacccctagccacctgcatcagagttggtgaggtggtttgaaacaattcatcctaatataaaaagaacagcttttgtaagggggcactgagtgtctcaaacagccgcatgggcaggaagagtgctcagtccagttttggttgaatttgtcttgttgccctaaggcctcctatgaaagactgacaggcttggactgaatcttgtgatctggacaccaagggtcacctgtgggcccagagctagctctgaagaatggggtagtttctttgagaacctccacagcaaaagtttggtcctctgttcccaatgcatgtcccactttaccagctacatcccccagtacctgcccatggctcatgactcatgaaatataaaactcagtaggcaggcataactggttcagacctgccagggctatgtgggaactatcattggtacaaaaactctaagtgtggagaagactgtggtagacaagaggggacatgtctgttctaaacgcacatcagaaacttccaatgactatggccaagtgagataagggtgtacagaacttctcaggacatgcagacctatgtgtcactcataactgaaattcaaataaatattttgtggatttcctgtggact

SEQ ID NO: 51763 - DNA, 338 bp, Homo sapiens
catttgtttgttctgcatgctgcagacattttgctctttgtcagatatctatcaatttaatccatgatgtctttgataaacagaaatattgcattttttatttagataaatcagtctttcatgatttctgctttcggtgttatgtttaaagaggtcttctctttcccagtgttatataaatatctgtctaatttttatttcattttttcagatttgaatttttactccaaatggaatttatttttgatataggtgtgattaagggtctaaatatttatttagttgttgtatcatcatttattgaaaactcacttttctactgttttaaaaattccaca

SEQ ID NO: 51764 - DNA, 402 bp, Homo sapiens
ccctccctctgcctgcttgagctgggacatggatcttctcctgccctcagccctctgggttctcagaccttcagactggaatccacatcactggccctcagctctcaggccttcaaactacaccagcagctttcctgggtctccatctggcagagagcagactgtgggacttcttaagctccatcatctcatgagccaataccttataatcaatctcttcaaaagatacacttttaggatatctattccgatagacagaccctattgtttcctgtgtctctggagagaactgtaatacactaggcaataatcagtcgtatttatagttatttcacatgacaaatgttctggtgtaattcaacagtaaaattaactcctcaataacacttaggccaacaattg

SEQ ID NO: 51765 - DNA, 348 bp, Homo sapiens
ctctgttacccaggcaggcatgcagtggcacaatcatggctcactgcagccctgacctccggtgctcctttcatctcagtcttgtgccacacccaactaattttttgtagaggtgggattttgccatgttgcccaggctggtctccaactcctgggctcaagcagtctccctaccatggcctcccaaagtgctgggatgacaggtgtaagccaccatgcctggccaggttgcttctaattatgcacagctctgtgatgagcatcatttgtagcttaatctttaggccacatccttaggataaattcttaagagaaaatctgatgaattaaagcaaatttttaaattat

SEQ ID NO: 51766 - DNA, 248 bp, Homo sapiens
atttcttattcaaactttgattttacaaatacagaaactacgattcagagaaatatagttacttgatttcacaaagctagacagtaagaatcaaggatggaattagattttctgaatccagaattttgagttttattatatcatatttttattacagcatgcttctagtggtggaagcaatccatggagtagtttacacagatgcataaatgcttatctttaaccctaaaatttaaaactttcataaa

SEQ ID NO: 51767 - DNA, 284 bp, Homo sapiens
atgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttgg

SEQ ID NO: 51768 - DNA, 84 bp, Homo sapiens
agttggtccgagtgttgtgggttattgttaagttgatttaacattgtctccccccacaaccgcgcttgactagcttgctgtttt

SEQ ID NO: 51769 - DNA, 222 bp, Homo sapiens
ctggtttgaagtagaaactacataggaattagactggtgctttataatttggcatacattctttgggatagtttaatacaataaggtaaaatatttcagaaaatgccacatataactccatatttacatatgctttatgaactgtaactctggctaatcaaatattaatgctttaaacagaaagcataaattttacatagcttgaaacatgtaagcagtgaa

SEQ ID NO: 51770 - DNA, 380 bp, Homo sapiens
gtcagttttgctagtacttggtgctttttctgtgtgtcttgtccatgatcaatatcctaactccattttaaaccaagtcctccaggaaataagcgagcccccacccaagtcgtttctttccctgccaaccagcttgggcctcttagttttaacgctgcaggctctctttgtgattttttgaggcgcaattctgggtgaacaggaggatgggcaggacagatcgacatttattgaatgcctatcacgtcccaggttttacatacacaatgctcgttcatcattctgacaaccttctgagggaatggggcattatctgcattttatacataaggtaacagaccaaaaaggttttagtaagtttacatagctggtagttgacg

SEQ ID NO: 51771 - DNA, 166 bp, Homo sapiens
gaagctggaacacaggctggcggcagcagggaagagtttcgctggccaggctgacgctgaggcgatggggtgctgctgaaggacgtgaaagcagaagagataggtggtcagatctagacctgaggaacgacatcacccacgccaggtcggggatggaggtagccat

SEQ ID NO: 51772 - DNA, 821 bp, Homo sapiens
tcagaactcagacccctcggctcttagtccaatgctcctctcctaacccaggttgcctttggggaccttgggggggtctctcatttcattgggaatgcctaatggcattggttgccacgtgttgccattgttggtgtatgtaagtcgctcttctgtcctcatatccccactctgtcgtcctgccccttcttgggggtggatcctgcaggagagggggaagcagccaagcaaggcttcatttctacttttccatctgcaggacccagggctgggcacatttggtgcaacaggctggaaatattctcccctaccccaccctccccatccctcctcagaggcactgggccggggactggagcctgtggtgaggtccttcccctcaaagcctgtcgggggcagccactaaatggccccaagatcccatggactcaagggattccatgtggcatcccttcccgtgctgcagaggctgggaaacttaaccacatttcccagactctcttgcagctagtgtttctgatggcatggaaatcctgccattgaatgcaaacgcacaagactagaatttggaactgagtttcgtggggagagaggcagggcatggagcatccaagcatccattttgctgtgtggatggtggtagagtgcaggcctaatgctggagctggcagttgtaatggtggcttctgaattccacagcttcttgatggaggcaggagccctggcatcttagcccagttcagcagcgttttaggcagctttcctggatgctcagacacttagtaataatatgcttgaaaaaaaaaagccctttttttccc

SEQ ID NO: 51773 - DNA, 188 bp, Homo sapiens
acattgtggtaacccctaaaatggaaggggtttgtttgtttttttgcttgtttgcttgctttaccaagtgtttacaatgagcaaggccttggaataagcattttatagacacagttttatttactctttccaacagccctagggggtaaaattactatcgccattttacagacaagaaaattgaagtt

SEQ ID NO: 51774 - DNA, 313 bp, Homo sapiens
ctttttcctgagatttttctgtttttagagttcacaggcatgtttttgtttttaacctgctgtccagcccaccccgtgtcccatgtaggacgtgtcgtatgcaggacgtgtcccgtgggcccccccccaaccttctgacatgggagtcccacggcagcctctgccagcattttcagttccaaagcctctcttgctgggcatggtgacacatgccggtgaatcctcatttgcctgggtctcgggaccctcccaccctggcctcctgactcggcacagtgttgcgtgcctgtgaatcctcatctgcctgggtctc

SEQ ID NO: 51775 - DNA, 329 bp, Homo sapiens
atggatgctgtggaaccccagaacctctccactataacctttactcattgccttaaaccagtctcaaatttacattatttcaataatatatttatttagggccacaaatccccatgcaagctccatttttagagaagttttttttttttttttaagctgttggctactttagccctcatgtagcaaaggttgctctttcttaaaatttctctgtccttcctaaagaattaattggacttgagtgtagaacctggatttgatcctgggtttatctctcactctttggcccttgaacatgttcattggtgtctttgagcatacctgtaaaa

SEQ ID NO: 51776 - DNA, 1447 bp, Homo sapiens
taaaatatgtgaaatccccttttgttctgaggattctttagtaggcaggagtgaccagattggaatatgcttggctggaaaaattaagattcaacttaacagactgttaataaccagaaccatcttctcttccgtaatgtggatttgccactgcaggtcaccctacaatgctatgttagaggtacaacactcctaccctcaggctataaacaaggtgaattattatctttatatctcttcatttagccctgatttgctgaagtgaaggcttgcttgagagttggttgcattataatttggtgagaatttaatctctcaatgacaacttacttgattccctcattctctttctgctacatagatcacagtagaccttggcagacagttctgtagttacataggtctgaattcaaaatccaggtctgccacttggcgtgctggtgaacttaagcaagtcaggcaatgcttctgatgtttttttcctcctccacaaagaataattaacatataacaatagggtctcagctagttgttttaaaaatggttagagagatgtgtggaatgaagtaagtgtgcagtaagtgttaactacaaatattattatcttagacatacagatttccatgattcatgaatggtgaagcatcttagaagacatccattctaagccaggcatggtggtgtgcacctatagtaccagttgctcagtagaatgaggcaggagaattgcttgagcctaggagtttgaggctagtatgggcaatatggtgagaccctatctcaagaaaaaagcaaaactttttttaaagcttaaaaagagagacatctgttccactactctcatcttagaggccagaaaactgaggctcagataatttcagagactttcacagatcccccaaccatttgatggcaaagccaggaatagaactctgctctcctttcccactgggacagtgggacagactgaccgatttttttctccacctctgctgtctcagcaatggtttgggacagtgtggatggaccagaagctggatagtacagagcccaggataaaaagttcagggcttcctgaagggaagctgcagtcctccctaggcccacaacacccttcgagatagaataaatacagcacccttctctacccaagttaggaaaggaagaagtgttacccaattagttgtatggggactgccaaagcacgccagtctgaagatgagcagaaactggctcattccatttggcacctagcacactaactgcaccagttaataggccacgcttttctccagagccattggctgaagagttcaaataaaaagtattgagaataggctatccaaaacagtaggctcagatgctatcacacaaagcactttatccttaagttcaatttttctaaattgtagttggctgctttggcttaataaaaaccttcataaaa

SEQ ID NO: 51777 - DNA, 155 bp, Homo sapiens
ccatggggaacaaattaatagttcattaatatggtgattcatttagtcagcaaatatgtgagtgttttcatccctatgactccaccagaattcctcttcaaggtcactaatgaccctacgttgccaagtccattggtcgaatctcagagttcatt

SEQ ID NO: 51778 - DNA, 909 bp, Homo sapiens
taactcattgggatttgttatgttcctgtaattttttcccactaacaatttcttaggaaattaaagattatggaacagatcacttacaaatcttaactcattaaaatgagcatgaataccataccctcaggagaagcagagttttgaaacacagttaagtgttagcaattgtgttctgctttaaaagaattataaaggaaataccatcatgttgaatttgttgaatatgaaagacaggaaaaattgtcatgtttcctgttgctcttttataaacactggaaacaaatttattatactagttgcatatgctttataaatttgatgacattagtcttttgatgaaaaaaatgttagaataacagaagatacttggaacatgctagaaaagggactttgtatgtaaatttgtctttttttcttaatattatacttttgttcttcaaaaattatttacattgctggtctcgagctcctgacttcaggtgatccaccaggcgtgagccacctcacccagccctgtatgcctaatttattcaggcatccgtaggcaatattcatgggttaaagattctttacccatttgaggttgcgtgagccaagaatggcaccttctgacttcagcctgtgcaacacaaggggagactccatcttcaaaaaaattattacttttggacaaaggtttcatgtagtataggaagtcaatacatactgttagtcgggccaagtggtctctcctttggtacggctcggtttttcaaatcgccacctcagctttgttcattggattcggtccagtaggccagtctaaaggcgtggcggttggcacctgccccttggcagggtacttggcgacgacatggactctactatacggggctcccacaataaggagctccaataacatctcat

SEQ ID NO: 51779 - DNA, 520 bp, Homo sapiens
tcccatttttataattattggaacatgaaactgtatttctatgaactcaatgatttttttccataaaattatatgctaagagagtcaccacaaaactatgaattctctcccgaattatttttgcttctttggagcaccatagtctttgttcaaatcacaacatgaaactgttgctgcaatgctaaagatgtgaatccaccactatcaatacggtcagggtaaaacctggagccacatgttattcaagttatttttgttatctaatgattgacatgaaaataaaatagtaagccaatattaatttgtaggcatagttgccccacttaaagtgtttacaaagattttcatgattaatctgggtttatgatttaatcctaactcattgtcattatttcctgaatgttgaactcccattataggaaattccacattttgttttgttttctttgtcttgtttaatagagataataaccatacacccctctccagaaaaaagtttttaaaaattattatgatatat

SEQ ID NO: 51780 - DNA, 199 bp, Homo sapiens
aagttctcccctcacaagcaaaatgggtccctcttgccttctcccccaaagaaatgagtatgttttacctgaccagtctgtttagtattttaaaagctgactgggcacgtggttcacgcctgtaatcccagcactttgggagaccaaggcaggaggatcacttgagcccaggagtttgagactagcctgggcaacatgg

SEQ ID NO: 51781 - DNA, 254 bp, Homo sapiens
taaatcttcccagataaaaggcctcaagtttggttattaagacaaggccttgttgacagtttcatatttaactgtttagaactcagctgtcagggctgtaatggggtgtatggccaaggggcacagggcctgggtgctgtttgtcacctttcctgcacctatccgggccctccctggtggagtgtgtctactgtttcctgcaatcccctcagttaacttctgggtgacctcgctgtgccttgcacttattcatt

SEQ ID NO: 51782 - DNA, 598 bp, Homo sapiens
cgtattatatgattccatttatataaaatgtccaggatagtcaaatcaacagagaccaaaagtagattaatggttgacagaggctgaaggtagggaggaaatggggagtgactttaatgggtacagggttttttttagataatgaaaatgttctggaattagtggtgatgcacaaccttgtacaacctttttgcaatatagtgcaataagacaatattgtacaatcttgtttatatactaaaagccattaaattacacactttaaagggggtgcattttatgacatgggaagtgtacattaaaaataaataactattccctagcaagctgactaaaaataataaaaataaaaaatatattaatacataaataagtaagctaggacaatgggatgaactaaaactgaatgtatgaatatccaagatctggcacttaatgtacttccggttcctaaagataaataactggagaatgctggggttgaagaagacgcccaaatgttttccccacaacaaaatgtttaaacctgaaatcagaaactttaaaggagaggctatactaatgttacatatagcttccagatcatctcaattttgcg

SEQ ID NO: 51783 - DNA, 1126 bp, Homo sapiens
  misc_feature (6)..(7): n is a, c, g, or t
  misc_feature (11)..(11): n is a, c, g, or t
  misc_feature (14)..(14): n is a, c, g, or t
  misc_feature (42)..(42): n is a, c, g, or t
  misc_feature (103)..(103): n is a, c, g, or t
  misc_feature (148)..(148): n is a, c, g, or t
gaattnncagntcngacaaaatgatgggaaataagtaaacanccttttaaatcttcaccagaaatcaatagggtttaaagatgatggacgttggtgttttttnctgcttaaggacttcaaccttttacgggaaaatatcttctctacntgtcagcagttttttccatgcacacaatgaatcgctgctgcaaatagaacattctgcatagaacattcttcatcattattataagaaagaagctgtgtaagactggccttggtaatgtagagccttttggggcatttttgtatgaaaagagaggaccatatcttacaattttgttttcatcataagtgtaatttatgtgccaaactttttcctcaactaaataataacagtttttatatactgagaacctcctttgtactgggcattgactgtgtgatgttttaaggtagattatttgaccccactttatagatgacaaaattggagcccagaggctctaagttcgtctgactagtgatagaactgatacttaaaaccctagtccatctgagtttaaagcttatccttttactactttccagctgtgtctctgaggacaggcactcaataggtgttcttgcccttggttctatttcttcggtagtggtatctcttattttctttctccttttccccctagtcagtaaaactaatataagtgatggccttcacatcatttaataagaggataagagctacatcatggtcattgaataaaagaatatgggttaagaactgcttcccagtatactctgcagatttgatttattatgaatgatttatgagatattagattgctgtatagtagttagcagtgtattcacaatcagctgcactctaatgccaagtgttgaaatattaactgaacgtatcatgtagtgtcctttgtttataacataataatcttgactttacaaaatagttaactttccagctgtttaatttgtacatatcattgtacaactgttatctttgagaaagcagcttatttattttgtgatttggaaatagtctttgtaattcaaactaagaaaatcaacttagttttgtaataataaatatcatggaacatacactgctaaataaaaattttcacat

SEQ ID NO: 51784 - DNA, 188 bp, Homo sapiens
ctgtccatgcaattataagatagcttaacaacaacatttctcagaacatatcgccattgttaaatgattcctgactgtgcttgcaacacaattttagtcattattgatagcagtctgctctattcactcaaaatcttctcttttctcaacccatcattcacgtgcatacatacatacacatatttaac

SEQ ID NO: 51785 - DNA, 464 bp, Homo sapiens
tttcatcatttgatctggcagcagggcagaggtgcaccaggagtaaaaacctttcaaaaaagaggtgtggctttcctcatcccctggcaaacattgtcaccaaggtgggatgttgctgctaatgggagagtcatcataaaaaactgtccctacaaggagagtgttacatggtgttgggggaagaaaacctacgcttcaggctcagagaaacctggattcaaatcctgcctctctcacttggaagctgtgttacactggggatgttatttacttgtttattagttagcacttagaatgagttcatttttaggtgagataatatattcacaatgatacacaaaagtgcacactgtgtgctccctttaccatttactatctccctccagccccaacgtgttaccactcttactagttttttgttaatctttccggcatttttaaataaaaaccaagcaaatgtaaat

SEQ ID NO: 51786 - DNA, 350 bp, Homo sapiens
ggactctctgaagcatctaaataaagacctggagcagaatgtcctcaggccctaaagcttgagtttacccagaagacaacaggtggcttgtgttctgctcagttctaggccagagcaacgggtgtcttcaaaggtttccactcacaaaagatccaattcagatggatgccttcagctccctctcccatccaaaagggagattagactccagattctctttcctgaatatcttttctcctgtgagttgtattgcttggattgagagaactgtctctgggcaaagacagttcagcaacagtggcacagatgaaaatataagtgcttccggaaccaaaacgatactcctcacc

SEQ ID NO: 51787 - DNA, 306 bp, Homo sapiens
tgcagcaggacagaggagagatgcgggtgcctcaggaggatatggcggagatgagggagtgagtcagattcgagttgggttcagaggcaggtccaaaaccctgcagtggttccatgtggaggcgaggggaggaaaggaatcagggatgactctgtggattcagctataccgtttgtgaggacaacggtgccaatctctgaaatgaggaagacggaaaaggaataggattggagacagaaggaattaagtgctgtcttttgaacgtgctgtgtgtgtgtgtgtgtgtgtgtgtgtgtctgtgtgtgt

SEQ ID NO: 51788 - DNA, 377 bp, Homo sapiens
aaagacggaaagacagaaagacaaagacagaaagagaaagaaagagtccaatgcgtggtggtaaagaaaggacaatccaggctgttaaaagcctgtcttgttacctagctcccacctggacccacatctgaacgtaaaaattgactcaagagaagaaaccatataggtcctcttgggatttctgctgtgaccctagaggctgggccgaggtccgctgaataggtagggatgactcagtgcctgctgtctagggtggctttgtgccgggcacaaagaaaggcgttcaatgaacatctggggctgctgttactgttactcccttgggttctcacaaacactctcagggtccggacacggtgcttctcagggacataaac

SEQ ID NO: 51789 - DNA, 132 bp, Homo sapiens
  misc_feature (23)..(24): n is a, c, g, or t
  misc_feature (119)..(119): n is a, c, g, or t
agtgagactccatctcggggggnnaaaaaatccctattacaaataaaagctgttgtgatccagactgcatatacctcaattccttactttctggtgctatgagattccaggcccatctngtatttcccctgc

SEQ ID NO: 51790 - DNA, 351 bp, Homo sapiens
cctttctgatcacagccccaccaccctgggcccccagcaggtgcgcctggctccctgcccacagtgtctgggtaggaagagttcggggcgggtgggagttaattgaaaggcaggcgtgtggaacgattgttggggaaggaagagacctgtagctggtatgggtgactcagccccgctgtcaggccctcacgagcaggaacaggaaggggggcagagggtgtgttaatggggagcagcgccatgcctgtgatgggcgggctctgctgcccagggttgggctgggggcccgccaagggtggctccaagttttcttggcagagcagcattaacctggggatgggagatgtggcc

SEQ ID NO: 51791 - DNA, 2022 bp, Homo sapiens
  misc_feature (1893)..(1893): n is a, c, g, or t
  misc_feature (1928)..(1928): n is a, c, g, or t
  misc_feature (1930)..(1930): n is a, c, g, or t
gagctcccacgctgctgttcttccatttccagcttttaaagagcacccgccccttcgaaccaccgaggtcatgggcgaacacaccggagcgcagaccgcgcccccccgcacacaccgcccgcctccgcgcccttgcccagaccgaggcggccgacgcgcctgcgtgcgcgctaggtataaataggtcccaggaggcagccactgggcagaactgggctacgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccggacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattcccagcacagtcacaaatttctctgttccatagttaaagaagacatttgccaacaggtagcatagctctgtacatcttttaaaaaaaaaatngcagggtactagtataataagctattttcacaagngnagcaatttcatggaacctgctcaaatcaaatttgtacatattgttataataaattttaaggtcttaactattaacttgattgaaaaaagctt

SEQ ID NO: 51792 - DNA, 1758 bp, Homo sapiens
gagctcccacgctgctgttcttccatttccagcttttaaagagcacccgccccttcgaaccaccgaggtcatgggcgaacacaccggagcgcagaccgcgcccccccgcacacaccgcccgcctccgcgcccttgcccagaccgaggcggccgacgcgcctgcgtgcgcgctaggtataaataggtcccaggaggcagccactgggcagaactgggctacgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccggacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatattttta

SEQ ID NO: 51793 - DNA, 1533 bp, Homo sapiens
tcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaactttcctgcatttatttctttcacttttacttcggtatcacactatactgcaaaaggtcatgtgttttctattacaaaagttattcttgaatcatggtacaattcgtgatgttttcatgtttactttttaaacttttaatgactataagaattttcaaaaacttcttactttaatatttttgaaaagagcctttttgaacactcattaggaatcattcttttatttttttcaaaatcttccccaatacagaaatcatggtgcaatgagctaagtggccagtgttagctttcaaattattcgggcctctagactaatattggcctgcaggcaaataggtaaaatgaaactgtgcgtcaaagtttgtggctgtgaagtttaccaccattggctgaacgatcagtgtaatgatggaaagttcaaagaagaatggtaaaaacatttgtctcatggcaacacttcttgtttatcatggcttgtttctcataggtaaagtgcccacctcttgaaatatcatgaacttcttcatatttgcatagaaagtgaactggagtgatgattcattaaaccgtattctactgtcatattaaattgtgtgcgtttgttggctcatggccagtgtatttgcaaacgtgtgcatagaaacatagtaaatattaagtaagatcacatgatgtttcattcttggacacgttgcttctgaaaacgtagactggtttggccttttacccttttaaccgggaagctttgggtcttgtttaattgggatgaaacagaaatggctatttttaaaaagctagcaaaggactctgtggtgagctgttttataacaaagagatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatattttta

SEQ ID NO: 51794 - DNA, 1797 bp, Homo sapiens
  misc_feature (1668)..(1668): n is a, c, g, or t
  misc_feature (1703)..(1703): n is a, c, g, or t
  misc_feature (1705)..(1705): n is a, c, g, or t
tcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaactttcctgcatttatttctttcacttttacttcggtatcacactatactgcaaaaggtcatgtgttttctattacaaaagttattcttgaatcatggtacaattcgtgatgttttcatgtttactttttaaacttttaatgactataagaattttcaaaaacttcttactttaatatttttgaaaagagcctttttgaacactcattaggaatcattcttttatttttttcaaaatcttccccaatacagaaatcatggtgcaatgagctaagtggccagtgttagctttcaaattattcgggcctctagactaatattggcctgcaggcaaataggtaaaatgaaactgtgcgtcaaagtttgtggctgtgaagtttaccaccattggctgaacgatcagtgtaatgatggaaagttcaaagaagaatggtaaaaacatttgtctcatggcaacacttcttgtttatcatggcttgtttctcataggtaaagtgcccacctcttgaaatatcatgaacttcttcatatttgcatagaaagtgaactggagtgatgattcattaaaccgtattctactgtcatattaaattgtgtgcgtttgttggctcatggccagtgtatttgcaaacgtgtgcatagaaacatagtaaatattaagtaagatcacatgatgtttcattcttggacacgttgcttctgaaaacgtagactggtttggccttttacccttttaaccgggaagctttgggtcttgtttaattgggatgaaacagaaatggctatttttaaaaagctagcaaaggactctgtggtgagctgttttataacaaagagatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattcccagcacagtcacaaatttctctgttccatagttaaagaagacatttgccaacaggtagcatagctctgtacatcttttaaaaaaaaaatngcagggtactagtataataagctattttcacaagngnagcaatttcatggaacctgctcaaatcaaatttgtacatattgttataataaattttaaggtcttaactattaacttgattgaaaaaagctt

SEQ ID NO: 51795 - DNA, 548 bp, Homo sapiens
atgtgtacctcagtagtttcttctcttggtggcaacttggaatgggtgggatactccccgccccaattccctcccctgcccctgccccgggaggtatctttggccatcaccgaggacacaggaaggcactctgggagatgcctgtctcatgatgggcttccttattaactgtgcctgtgtctccttcgcgaggctcataccttctttggttttcatgagaaaccaaaaatattgcattcactgttttttttctcaatcggagtgtgatcaactgcttacgggctctcaggctgactccctgagcatgggcatggcagcacctggcagcatccctgtggtacgagcccagcctgtggtgctggggatgaaggagaaactgagaactctgtgttgtctttctcagacaagccttcatgtattgtattttctttaaagcctgttctttagggtccaggtcaaaatatgtaccaatttcctggcaataggtccctctttaaaacagtgaattttttttggtattttattgtgaaaaatttcaaacgtacaaa

SEQ ID NO: 51796 - DNA, 494 bp, Homo sapiens
atgtgtacctcagtagtttcttctcttggtggcaacttggaatgggtgggatactccccgccccaattccctcccctgcccctgccccgggaggtatctttggccatcaccgaggacacaggaaggcactctgggagatgcctgtctcatgatgggcttccttattaactgtgcctgtgtctccttcgcgaggctcataccttctttggttttcatgagaaaccagggctctcaggctgactccctgagcatgggcatggcagcacctggcagcatccctgtggtacgagcccagcctgtggtgctggggatgaaggagaaactgagaactctgtgttgtctttctcagacaagccttcatgtattgtattttctttaaagcctgttctttagggtccaggtcaaaatatgtaccaatttcctggcaataggtccctctttaaaacagtgaattttttttggtattttattgtgaaaaatttcaaacgtacaaa

SEQ ID NO: 51797 - DNA, 393 bp, Homo sapiens
ctggattccccctgccaaggcgaatggagctatttagagacctgctcaggaaaaaacagtcctgcagccaggaggagagggtccccaagggcagacagacagggctggacggcagctggaggggccattgaaggtcacaggaaggtcatgggggtgctgaaggacaggaagatgagaggacaaaataggtgagtggggctaggaaggtggtgaggcttaaactggccttaaagccgtgggccgaatctggctggttgtctgctttcgcatagcctgtgagctaagaatggttttaacatttttaaatagttgaaaaaaaattaaaatttggtaacgtgaaaattgtatgaaattcaggtttcaatgtgtgtaaataaagttttattggaacac

SEQ ID NO: 51798 - DNA, 112 bp, Homo sapiens
gatcactggctgctggggtgagatggaagcagggaagatggataagagactcccacaataatccaggcaagagatgaaggagtcttggtccaggatggtaacagtggagggg

SEQ ID NO: 51799 - DNA, 1038 bp, Homo sapiens
ctttcttcctctgcctttgtgtttggtaagatccttcctccccacatccctccttctgttccctcttaccctgccaatcctgatagtcccttcagggccggtttccttggagcttgtccctccagggcctgtgcacttgcacctcttctctggcattacttgttgcttgtcatttcacctccctgctaggttttaatctagaaggcatgggccacagtgtctttcttctctgtgcatccccagctccctacacaaagctggtgtacagcaggggccagccatctccaaattgaattctgtcagcttgggccattatgtatcaagatggggcttggagaggtcacagagctttccaaaaaggctggtggaaaattacactgaaaagggggcatttccatcttctgggtccttccctggtttttttgccaccaccaaagagattgttctgacaggttctgcccaattttggaaggtggttcagttattcggtgactgagtcaaatgagatcatctctcttagctgccttgtcagacacacaggaagaagaggagaccaccggagtcctgcccagggacagcctttctcacaccatagcagggagctggtgatcacggaggctgcctggagcctgtcagcaggctagagactgtgtggctcagcctccaggccccttggaagccttcgggctcagcttttttcagtccccaggaccaggcctcagaacacagagctgatatcccaaatgctgttgtcagagatcaaatttggggaatgcataaactggttttgacccacactggcaggtctttatcttcaaaatgctgggatattaggcagatggtcttaaaaagcttcttaaacactttagaaatgaaagaaagaaaatgttcagttgctctgggatggttaacagaaaagtactctgctcatcctataaaccaagtcttatgaaatccaaactgaagatgagtagggattccattacaaagtctgcagactgatttcctctgcgtctctaggccctgggcacatggagt

SEQ ID NO: 51800 - DNA, 1574 bp, Homo sapiens
gcttctctccatcttgtgattcctttttcctcctgaaccctccagtgggggtgcgagtttgtctttatcaccccccatcccaccgccttcttttcttctcgctctcctacccctccccagcttggtgggcgcctctttcctttctcgccccctttcatttttatttattcatatttatttggcgcccgctctctctctgtccctttgcctgcctccctccctccggatccccgctctctccccggagtggcgcgtcgggggctccgccgctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggttttttttttt

SEQ ID NO: 51801 - DNA, 1223 bp, Homo sapiens
gagaagggagtagacaactgttcctgagggaaatctgggaagggttcatggagctgattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggttttttttttt

SEQ ID NO: 51802 - DNA, 1255 bp, Homo sapiens
gcttctctccatcttgtgattcctttttcctcctgaaccctccagtgggggtgcgagtttgtctttatcaccccccatcccaccgccttcttttcttctcgctctcctacccctccccagcttggtgggcgcctctttcctttctcgccccctttcatttttatttattcatatttatttggcgcccgctctctctctgtccctttgcctgcctccctccctccggatccccgctctctccccggagtggcgcgtcgggggctccgccgctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagcaaacctgtagttttctctgttttcacacctgctctgtattagcattccacacccaacctgcctcctaga

SEQ ID NO: 51803 - DNA, 951 bp, Homo sapiens
  misc_feature (896)..(896): n is a, c, g, or t
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacagaggaagctgcaaaacaaatgagaagcagaggaaaagttctgaagactaaagatgatactttgaagtagaagaagctgatgccattcagcttggttcaaccttttatgtttaaagttggtaactggtattgacaactcatggacctgtgagcacatgaaacagttattctcaagtggcacaanagtggtggtttgtggtgatgtactcccccacatactgatcagagaggtgtcattt

SEQ ID NO: 51804 - DNA, 2811 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51805 - DNA, 2757 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51806 - DNA, 2825 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaagtgctgggattacaggcatgagccacctcgcctggccgcttttacctctttttttctgcctaggccttactggtcttcagagctaaaatcagttaaaattttttttattgtcatccattttatgctgaaaaaattaagctgctaaattaagtgtcctaatatagccagtaatgctgaatctcaaaagtccacattagaatcccatgtcttgatttggtaggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51807 - DNA, 1854 bp, Homo sapiens
aggataagcattttctaccttggtgatatctgcaaaaaatctatctgtctaaagtcctcatttcattttcatagttggacagcaagtaaggacaccatcctgacattagttgaggatagtgctgtaacctgaaaggctcacattgattttcatgtctgtttttttccatttgatccctggtttggcgccgctgtgttttccaggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51808 - DNA, 2770 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaagtgctgggattacaggcatgagccacctcgcctggccgcttttacctctttttttctgcctaggccttactggtcttcagagctaaaatcagttaaaattttttttattgtcatccattttatgctgaaaaaattaagctgctaaattaagtgtcctaatatagccagtaatgctgaatctcaaaagtccacattagaatcccatgtcttgatttggtaggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51809 - DNA, 124 bp, Homo sapiens
tattcttaggattttatttttcatttattttaagtaaagaggtatgtgtgtcattttttatgacgttttttgcttttgttttggacatgcatagatgggagtacatgcattcaccctcagagaa

SEQ ID NO: 51810 - DNA, 3176 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataagaaaaaaaaaaaaaaaaaaaaacaaaataaaaaattaaaaaaaagaaaaaaaaaaaaaaaaaaggggggggggggaaaaaaaattccccgggggggccccgttttagctcccccgttttttggtaaagaggggcgcgcccaaaaagggagcgcataaaatacaaaaaacgaacgggggacgcgtcaacaaaccgcgcgcggcggaaacactggtctcgcggaaacttggggaagaacccatatctgggggcggagccaatgtgggcacatccccaaagatataaagcccagggaaaaaactgacgcgtctgcggaccaccgaattctcgggagattgcacgggtataaaagagcgagtaaattatgt

SEQ ID NO: 51811 - DNA, 2756 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51812 - DNA, 2482 bp, Homo sapiens
ccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagagcggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataaga

SEQ ID NO: 51813 - DNA, 2339 bp, Homo sapiens
agataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccacttcggttactcactgtcctcatgctttgatgtcagttgttctcctaaattttaaaattttgttatgaagattggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactggccagtttgaggtgcttccattggtctgggtaactagccatttcttcctgattgtgcctagtatatcccagacagtttgtttctatgcagaagaattttatatgaaattttcatttctttgcaaaaacttgttccttctttcagttcatgacatcatccatgctaaagtctgagtcatctgcttccatttttgttattccccacatccagtcttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaa

SEQ ID NO: 51814 - DNA, 2799 bp, Homo sapiens
agataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccacttcggttactcactgtcctcatgctttgatgtcagttgttctcctaaattttaaaattttgttatgaagattggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactggccagtttgaggtgcttccattggtctgggtaactagccatttcttcctgattgtgcctagtatatcccagacagtttgtttctatgcagaagaattttatatgaaattttcatttctttgcaaaaacttgttccttctttcagttcatgacatcatccatgctaaagtctgagtcatctgcttccatttttgttattccccacatccagtcttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaaaaaatgaattctcatttctcgacataaagccttgtctaaagtgagatgttttccaggtcatacataggtttctccctggggtaattggaagttcttgcatataaagttggttaaatagtaataattatgagttaaccacagaaaatttcagaaaactttaatttttttccattggaatcagcatggatatgtgtatatggatggttcaataaatatacttttatatacatgtttcacagaaattttacattccatcttcaaactgcagaaatagattttttttttttacaagccaaaaaataactgccataacttttgtgacttcatgcaaaaaaaggggggaagagtaaggggcaaaagggaattagttgttcaaggttgagtgtccagtaagaagtaaaaatgttacattaaggaagcgattgcttaacacgctgcttaaggtggtagccagacaaat

SEQ ID NO: 51815 - DNA, 1958 bp, Homo sapiens
agataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccacttcggttactcactgtcctcatgctttgatgtcagttgttctcctaaattttaaaattttgttatgaagattggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataaggggccgcgacttcctcccactctttctcgtttcataagccacatcgcctaattctcgttttctcccctatacggcccccataacttccacgccgcgtacgctcctcaaaactcgcaaacctc

SEQ ID NO: 51816 - DNA, 2298 bp, Homo sapiens
agataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccacttcggttactcactgtcctcatgctttgatgtcagttgttctcctaaattttaaaattttgttatgaagattggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaggaagtcactggccagtttgaggtgcttccattggtctgggtaactagccatttcttcctgattgtgcctagtatatcccagacagtttgtttctatgcagaagaattttatatgaaattttcatttctttgcaaaaacttgttccttctttcagttcatgacatcatccatgctaaagtctgagtcatctgcttccatttttgttattccccacatccagtcttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaa

SEQ ID NO: 51817 - DNA, 1233 bp, Homo sapiens
  misc_feature (460)..(461): n is a, c, g, or t
  misc_feature (468)..(468): n is a, c, g, or t
  misc_feature (472)..(472): n is a, c, g, or t
  misc_feature (482)..(482): n is a, c, g, or t
  misc_feature (491)..(491): n is a, c, g, or t
  misc_feature (494)..(495): n is a, c, g, or t
  misc_feature (499)..(499): n is a, c, g, or t
  misc_feature (501)..(501): n is a, c, g, or t
  misc_feature (507)..(507): n is a, c, g, or t
caaagctcccgactgtccgcagccccggccgctcacagatggagggtcccagggcctaggacgcagcccccagcgggaagctccagctggccgtgaagaggccgagtcgagagccgggaggcgcgcgggggtgggcgctgcagccgcgggttgtttatctggagtacggaggggaggggggagcctggaaaccgccccgtgtcccatttcctcctcttgttttcgctccggattctccatgttggacccaaactgaggagcccggagctgccgctgggggatcggggccgggggcacccgggggagccgctgcccgggccgcccgccctttgtacaggccgcctcccttcccggtccggggaggaaacgagaggggggatgtgaacagctgtggaagtcggagtctcgggagccggagcgggccgggaggcgggccgtacagagggcgggcggccgggcnngcggccngacntggcggccangcgagcccngannccgncngcactnaggtacagggaacaccagtcacagacatacaaaccatgccgaccgagaacacagcccctagatagagctacaccagagcacaaagaacagaggtacgacccaaacgaaacgactacactacaggaacgcctacggtgagacgtcaacatccttctacccgaccatatccagtagcctggtaaatacgcagcacaaagacatagcacgggccagacagaagatccactacacaagttgaactgcagcaagacgtactcaaaggagagacggcaaagacgaccaataagcataagagatcgacgagttcgtggcatccaagcaggatatacacaggatacagacggagcataaccaggagatcacaaggaaaccactgccaatggataccacaggacggcttgaacaaaaggggaaggaatacaagagacagagaagacatgaagagggagcaggagagccgtagatggcaaggcacataggtgcattacgatccctccaaaggcgcaggcacaccacatgacagaatagacatcaacggcggtaacagagatattgacggggcacgaaaaaaaacgaggacaaagaagcaaagaaaggaatgaacgagacagagagataagaggagaacgaaagaggagaacaacatcgaagagagtgacgaagcgaggcaagatggggagatagaacggaacgatcacacccgaacgcgccacagccaggcctccg

SEQ ID NO: 51818 - DNA, 4737 bp, Homo sapiens
  misc_feature (1547)..(1547): n is a, c, g, or t
  misc_feature (2726)..(2726): n is a, c, g, or t
  misc_feature (2893)..(2893): n is a, c, g, or t
ggcggcgtcgggctccctcccggctgcctctgaccagtttcgctgagcaaacaagcccgaccctgaggcccggccagagcccctccctgcccggtgcgctcccccggggccggcgctgcacacacagagccgcgtttgtttagcccgggagcggtgtccctggttacataattcgccggatggcatcagacccggcgtggttctgaatcgcgcagcgaaaaagtgcgagttctctgtgggcagcggctggcggcccccgccttccagagcgtcaggtggaggcgcgagggggcccgcaggccctcgcgggggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcanacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagcctacatccttcctgggtgttgcttttcctcttaagggcctcagaactcttgctcttcctggggtgagggggaatgagtgttcttgacatgtgacagcctaatgcgcatgctttctgcctctggtaacaggagtgagtgagcccctcagacctgcactctgggtgtctcctgcttacaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttntgagaaaagcaggtggtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggncatttccgacagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattggaggaggggcctctcttccaagccccaccctaagggttagcccttggacaaatcttgtgccgtctaggcccagccaggcttttctgactaaataagcaataagaggctctaagctgactgagttgcaaggaccctttccgccctcccttggatctccatgtttctccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttgggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattccaaaacttgaaatgcaggacgccattaagtgtctgtttatatttttggaatatttgtattacttacaattaattaataaaagtgggtttaaaaaacctttccagg

SEQ ID NO: 51819 - DNA, 4997 bp, Homo sapiens
  misc_feature (1807)..(1807): n is a, c, g, or t
  misc_feature (2986)..(2986): n is a, c, g, or t
  misc_feature (3153)..(3153): n is a, c, g, or t
caaagctcccgactgtccgcagccccggccgctcacagatggagggtcccagggcctaggacgcagcccccagcgggaagctccagctggccgtgaagaggccgagtcgagagccgggaggcgcgcgggggtgggcgctgcagccgcgggttgtttatctggagtacggaggggaggggggagcctggaaaccgccccgtgtcccatttcctcctcttgttttcgctccggattctccatgttggacccaaactgaggagcccggagctgccgctgggggatcggggccgggggcacccgggggagccgctgcccgggccgcccgccctttgtacaggccgcctcccttcccggtccggggaggaaacgagaggggggatgtgaacagctgtggaagtcggagtctcgggagccggagcgggcccccgcccaggccccccagcccagcccagcccgcgcgcccgcccgtcctcccgcccagccagcccgggcccgcgggattgttagatggaacacggctccatcatcacccaggcgcggagggaagacgccctggtgctcaccaagcaaggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcanacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagcctacatccttcctgggtgttgcttttcctcttaagggcctcagaactcttgctcttcctggggtgagggggaatgagtgttcttgacatgtgacagcctaatgcgcatgctttctgcctctggtaacaggagtgagtgagcccctcagacctgcactctgggtgtctcctgcttacaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttntgagaaaagcaggtggtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggncatttccgacagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattggaggaggggcctctcttccaagccccaccctaagggttagcccttggacaaatcttgtgccgtctaggcccagccaggcttttctgactaaataagcaataagaggctctaagctgactgagttgcaaggaccctttccgccctcccttggatctccatgtttctccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttgggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattccaaaacttgaaatgcaggacgccattaagtgtctgtttatatttttggaatatttgtattacttacaattaattaataaaagtgggtttaaaaaacctttccagg

SEQ ID NO: 51820 - DNA, 423 bp, Homo sapiens
acaagtgcattcaacaaatacttatttaattgtattggtggttagagggttgcgattgattaaggcacattaatggatccgtgtcctccctgtatccaagattctgccatttgtctctgcagttcctcccactgaagaatcggagtatatttctccagtccctaatgttgggtttagtcatgtgtctagctttggccactggaatattaatctgtatgaccaaaaacttggaaagtgtgaattcatttctgctcactcactcctgctatcaccatgagaacaagcccaggccagactgctgcttccagcagaagagacagcaagagcaacgtcgagcttcccagacatgctcatgctagattgaccaatcctcagctgacccatagatccatgaaaataaacgattgttgtattaagccactg

SEQ ID NO: 51821 - DNA, 412 bp, Homo sapiens
aaacaaaatcagtcttttgtcaaaaggaaatgaagttgccatgccactgttcactcctgtaagagactcctctgggctgttccattctcttgctgcaattcagccggttgaaaaactaaggtgactgcacaatgattaacttcaggcccttctgctctactttgagcctgtctctggttcaacgttacactctccgctcagcacccgcagactcaagagatttccaatcccccaatttagcgtggttctaccttaggcagaactcccatccagttcggatataagcgggtcgaagtggcagggaccacctcgctgggaggagaggctggagctgcggtcttaaaagatcttggggccgggcgcgatggctcacgcctgtaatcccaacacgttgggaggccgaagcgggtag

SEQ ID NO: 51822 - DNA, 365 bp, Homo sapiens
gtcaatgatcacctacctttttagctgtatattctattttaacgttataagaattttgacttaaaagtccattaaagtagaagtttatttttaatccaatggctttatcaaataaaaatgttagtggtctcttcaactaatacgattcaaaattctaccttatgatctggtgatttaatgtgacctgtcaaaagatacttactacctctgtggactatacatacccaatgtatgttaatatgtggaaatccttgttttgttttgtttttttttcttttggagacagaatttcactcttcttacccaagctggagtgcaatggcacgatctcggctcactgcaaccttcgcctcccgggttcaagc

SEQ ID NO: 51823 - DNA, 433 bp, Homo sapiens
tgaaccttcaattggagagcctgcaccttaagtctctcctccaagtggcttagtttaattgaagtgatctgtgtgccaccacccccttgtggttggatggagccatgtcattagttctggccaatgagctgtgagtggtagtggcttgcgttaattctacgtgagagcatttcagtgctggagaaacctgcgaggacctctttttccctctgtgcagtgaccagcagtgcttcctatggaactgttcattagtgtaggtcctggaatgaggatgcatggcgcagggcccttaatctgtccaatctgactgtgatgtgggagagacttctagacatgttgctttctctagggtatgttcttatatttcccattaccccccaccccctgcaaaaggactgggcctgttttgggaaggtgactgatacccgcactg

SEQ ID NO: 51824 - DNA, 1961 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51825 - DNA, 2065 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51826 - DNA, 2029 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51827 - DNA, 1864 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51828 - DNA, 1795 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51829 - DNA, 1759 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51830 - DNA, 1594 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51831 - DNA, 1394 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51832 - DNA, 1498 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51833 - DNA, 1333 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51834 - DNA, 2035 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51835 - DNA, 1935 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattgggccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51836 - DNA, 1686 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtgagaaacagctgaggctctgctgggaaataatgaaaatagccctggggcttttgagtgtggggctgaggaaatgggtaggaatgctaggtacaagaagggtaaaactgggacaatcaaaataaagaaggatagagtatgacagtagttaaattttaagaaaatggaagtagagaattagacatactaacagaaaaaggaggaggaactagtgatttagtgggagagggttgggaggagatcacagacaaaggatcaggaggaattgaaatgagggctttggaaaacccagatgaaaattctaggaaggtcccacccttgtgaaatgggaaatctcagcttggtggaatagagtattttagggttggtattcttattctatccccaaccaggtggatattccatctttctcatcctgatctgtttgactgtgatagttaccctggtcatattggttgtagttgactcacggttaaaaaaacagaggtgagctttttcttgttctttgtttcttcagcctgtaatcaattcattcctttttcc

SEQ ID NO: 51837 - DNA, 1178 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaatgtaagttcgttgctctaagctgataatttgcctgggaacaccaactattttccaaagtggaagatagtatatagactctgaccatcatttaaccttactaaccttgttccccactctctgactcccactccctcctctgcttcacccttcaccaccacccacactccaccatatacacaaaagggcctgcatgtacatatctcaacatgaatatagcttcatgtctggctctttggaatgattgtctcctctggatcttctgcccctcattcctgccctcagactcagcctttctcaaccctctttctgcccttctttatcctttgcctgagtgttgacatggactggcctgtacctaaccactttcacgtgaattatttatgaccaatctcctatcttcctgatagccttcccatctaccactttcccattagttatttcaaagtatctttattatcttcaaattttcttcccctttgccagtaaactctagtctccatatgatttcccagcaaatttttcttcccttgaatctctttactgtctaaattgtttgtttttcttccttgtcattctttccataa

SEQ ID NO: 51838 - DNA, 1462 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51839 - DNA, 1297 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51840 - DNA, 2457 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccggatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtgagaaacagctgaggctctgctgggaaataatgaaaatagccctggggcttttgagtgtggggctgaggaaatgggtaggaatgctaggtacaagaagggtaaaactgggacaatcaaaataaagaaggatagagtatgacagtagttaaattttaagaaaatggaagtagagaattagacatactaacagaaaaaggaggaggaactagtgatttagtgggagagggttgggaggagatcacagacaaaggatcaggaggaattgaaatgagggctttggaaaacccagatgaaaattctaggaaggtcccacccttgtgaaatgggaaatctcagcttggtggaatagagtattttagggttggtattcttattctatccccaaccaggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51841 - DNA, 1664 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagaccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttagggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaag

SEQ ID NO: 51842 - DNA, 1212 bp, Homo sapiens
  misc_feature (1131)..(1131): n is a, c, g, or t
tttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacntactgtgggaaagccttcactagatcaactcaacttactgaacatgtaagaactcacactggaataaaaccctatgaatgt

SEQ ID NO: 51843 - DNA, 660 bp, Homo sapiens
ctttcatccaataggtagacagatttctttctagacagactcatcttcagagttttcttagagcaaatgaagccttactcaaggactgagtccccagatgaatttccccagggaatgaagtctcctatacataaaatgttaacttgaaaatcagtccagtagctcagtaattactacttaagcttgaccttcatggtgccaactgcatctttcttacattgctgggtgcggtgacggatgataaagcagatgaaagtgtccttttatcaaatcattcacttatcagcatttatcaggtatctgcagtgtgctgaggagtgtgctgcatagacaccaatgggacaggaagagctcctagcctggttgtgctgagatcaagcgtaagcagtgtgcagtggctcatgcctgtaattccagctactcaggagacagaggtgagaggaccacttcagcccaggagatcgaagctgtagtaatcagcagttgtgcctgggtgacacagttggaccctgtttttatatataaataaataaacagattagatagatgatagatagaggaaaattcatctttaggaagtactgttctaatcaaaataaaaataaaatttaaaatttaaaaatacaaatattaaaaaattaaaaatagatcagcaaaaaa

SEQ ID NO: 51844 - DNA, 1458 bp, Homo sapiens
  misc_feature (1377)..(1377): n is a, c, g, or t
tttccggcgctggctcctctccgtcagtgcggtttcgcctttatggtggtggagtctgcccaggctgtggtgagttccacctccttggcggtcccggggatagcagggggcggcaaaggaatgattgcgcgctgtcgcctaggagcctctcagatccgcttcacttcactcgcttctccagggactatcagtcctccctgtgcgtccagttcggagaggctgcgcgctctctcggctcactgcaacctctgcaacctctgcctccagggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacntactgtgggaaagccttcactagatcaactcaacttactgaacatgtaagaactcacactggaataaaaccctatgaatgt

SEQ ID NO: 51845 - DNA, 907 bp, Homo sapiens
  misc_feature (826)..(826): n is a, c, g, or t
ccactcctctggggagaggtatttctcagttgtgtccagtaaagcccactcctctggggtgaagtccacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacntactgtgggaaagccttcactagatcaactcaacttactgaacatgtaagaactcacactggaataaaaccctatgaatgt

SEQ ID NO: 51846 - DNA, 1398 bp, Homo sapiens
  misc_feature (1317)..(1317): n is a, c, g, or t
tttccggcgctggctcctctccgtcagtgcggtttcgcctttatggtggtggagtctgcccaggctgtgggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggtatctgcagtgtgctgaggagtgtgctgcatagacaccaatgggacaggaagagctcctagcctggttgtgctgagatcaagcgtaagcagtgtgcagtggctcatgcctgtaattccagctactcaggagacagaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacntactgtgggaaagccttcactagatcaactcaacttactgaacatgtaagaactcacactggaataaaaccctatgaatgt

SEQ ID NO: 51847 - DNA, 429 bp, Homo sapiens
atagatcagcaaaaaaagatttaaaaaaattttaaaaagtgctgtttaaggcatatgcctgtaggaggtcaaccttgagtgtttagacacaagagctcctgagacattaaaccctggagtagatcatgggagacctgacaaccacgtgtaagtgagtataaggttccccttcatcattctccagtgaatattggtggaagtgttcattggctcaaaccagcatgtgtatgatgacataggattcagtgacgtttgatgatgtggctgtggacttcaccccagaggagtgggctttactggacacaactgagaaatacctctacagagatgtgatgctggagaactacatgaacctggcctctgtgggtaagagtaacatcactatgcttggcatggtggcctgcacctgtagtcccagatacttgggag

SEQ ID NO: 51848 - DNA, 334 bp, Homo sapiens
  misc_feature (1)..(3): n is a, c, g, or t
  misc_feature (188)..(188): n is a, c, g, or t
  misc_feature (329)..(329): n is a, c, g, or t
nnnatccatgtagaggaggagaacagtgcataaaacatagtaagcactcaataactgttacttgatattactacttcatcagagtaaataaaaataagacaccaggaatgaaagatttaatccaaccttctttcaaaaccaaaggcaaactgttcattagccaaaccccaccattccttgtttaaatnattgcgatcacctcctacctagccttgtagccagcagtctctcccattcatctactgtcatcagtcagatttattttcctaaaaataatattaacatttctagttcaggatatgatgaactaacttcctgctgcaaaaaanaaaaa

SEQ ID NO: 51849 - DNA, 360 bp, Homo sapiens
gtcatcaatgtctctcatacagaaaactcaattgttgatttgcttgccaaacaaacaaagtataaaataattaacagtggtcttgcaattaaatagtaatttagcctcagctttaatgtttcaattaaaacttaataagcatgcacgagatgtatttgcagtgtatgctgagtagtgataaaaaacacttgttttgcccacttttgcaaactggtagatagaacatatttgtttacttgtaacatgataattcctcgaggtgtgaacactggggtatggaagaggtgaagagacaaacattataacaggtattctgcagaagtgtcaagagatgcagaatgttgcaacacaaacaaaaga

SEQ ID NO: 51850 - DNA, 2070 bp, Homo sapiens
  misc_feature (1113)..(1113): n is a, c, g, or t
  misc_feature (1222)..(1222): n is a, c, g, or t
  misc_feature (1615)..(1615): n is a, c, g, or t
ggtaagctaaccgaggagggactttagtgggaacacatgacatataatgcgagactttacagaagaagttcagaaaagtcactaaataaatagcaactactaacacaagcaggagtaacaccaaaccctggcagcatggatctgattttcagaattgctacattatattatttaaaatattcaatttttaacaaacatttatgaaagatgcaaggaaacaaagtatggcccaaacacgtggttgggggagaaataagcagaaattgtccctgagaaggaccagatgttagacttactagacaaagatttttttattttttataggtggggtcttgcgaagttacccagggtggtcttgaactcctggcctcagcctcaacctcagtctcagcctcccaaagtgctgggattataggcacgagcgaccatgcctggcctagagaaggatttaattcagctatttaaaatatgttcaaagagataagagaaacgattcagttctgtagactagagaactaaaggaaagtatgaaagcaatgtctcatcaaatagagaatatcaataaagagatagaaaccataaaaaggagtcaaatagaaattctagagttgaaaagtatggtaactgaaatggaaaaattattagaggttctcaatggcacattacagcaggctgaagacagaatggggaacttgaaggttaattgagattgttgactctgaggaacagaaataaaaatgaatgaaagtgaatggaatctcagagacctgtttgtggaacacatcatcaagcttactaacatacacataatgagcgtcccaggagaagaaaaacagaaaaaaggagaaagaatatttgaagaaatgatggccccaaacttcccaaacatgatgaaaaacaatctgcatattcaagaagctcaaggaactacaagtaggaaaaactgagggatccacatctaaacatactgtaatcaaactgacagaagccaaagacagaatatcttgaaagcagcaagagaaaagcaactcatcacatacaagggatcctcaataagattaatagctaatttctcttcaaaaacaatgcaggtgctggacatggttgctcacncctgtactcccagtaccttgggaggcttgaggctcaagaattgcttgaagccaggagttggataccagcactggcaatagagtaaaaccctgtctctacaaaaaatttnaaaataactgggcatgcccgtctgggatgtgaggagcgcctctgcccggccgcgaccctgtctgggaggtgaggagcatctctgcctggccgccccgtctgagaagtgaggagcccctacgcctggcagccgccccatctgagaagtgaggagcccctccgcccagcagccgccccgtctgagaagtgaggagcccctctgcccggcagccgccctgtctgggagggaggtgggggccagcccccgcctggccagccgccccctccgggaggtgggggggcgcctctgcccggctgccccttctgggaagtgaggagcccctctgcccggccgccaccccgtctgggaggtgtacccaacagctcattgagaacgggccatgatgacgatggnggttttgttgaatagaaaagggggaaatgtggggaaaagatacagaaatcagattgttgctgtgtctgtgtagaaagaagtagacatagaagactccattttgttctgtactaagaaaaattcttctgccttgggatgctgttgatctatgaccttacccccaacccagtgctctctgaaacatgtgctgtgtccactcagggttgaatggattaagggcggtgcaagatgtgctttgttaaacagatgcttgaaagcagcatgctcgttaagagtcatcaccactccctaatctcaagtacccagggacacaaacactgtggaaggccgcagggtcctctgcctaggaaaaccagagacctttgttcacttgtttatctgctgaccttccctccactattgtcctatgaccctgccaaatccccctctgcgagaaacacccaagaatgatcaat

SEQ ID NO: 51851 - DNA, 1576 bp, Homo sapiens
  misc_feature (619)..(619): n is a, c, g, or t
  misc_feature (728)..(728): n is a, c, g, or t
  misc_feature (1121)..(1121): n is a, c, g, or t
aattaccttaaagtccccattctgtcttcagcctgctgtaatgtgccattgagaacctctaataatttctccatttcagttaccatacttttcaactctagaatttctatttgactcctttttatggtaactgaaatggaaaaattattagaggttctcaatggcacattacagcaggctgaagacagaatggggaacttgaaggttaattgagattgttgactctgaggaacagaaataaaaatgaatgaaagtgaatggaatctcagagacctgtttgtggaacacatcatcaagcttactaacatacacataatgagcgtcccaggagaagaaaaacagaaaaaaggagaaagaatatttgaagaaatgatggccccaaacttcccaaacatgatgaaaaacaatctgcatattcaagaagctcaaggaactacaagtaggaaaaactgagggatccacatctaaacatactgtaatcaaactgacagaagccaaagacagaatatcttgaaagcagcaagagaaaagcaactcatcacatacaagggatcctcaataagattaatagctaatttctcttcaaaaacaatgcaggtgctggacatggttgctcacncctgtactcccagtaccttgggaggcttgaggctcaagaattgcttgaagccaggagttggataccagcactggcaatagagtaaaaccctgtctctacaaaaaatttnaaaataactgggcatgcccgtctgggatgtgaggagcgcctctgcccggccgcgaccctgtctgggaggtgaggagcatctctgcctggccgccccgtctgagaagtgaggagcccctacgcctggcagccgccccatctgagaagtgaggagcccctccgcccagcagccgccccgtctgagaagtgaggagcccctctgcccggcagccgccctgtctgggagggaggtgggggccagcccccgcctggccagccgccccctccgggaggtgggggggcgcctctgcccggctgccccttctgggaagtgaggagcccctctgcccggccgccaccccgtctgggaggtgtacccaacagctcattgagaacgggccatgatgacgatggnggttttgttgaatagaaaagggggaaatgtggggaaaagatacagaaatcagattgttgctgtgtctgtgtagaaagaagtagacatagaagactccattttgttctgtactaagaaaaattcttctgccttgggatgctgttgatctatgaccttacccccaacccagtgctctctgaaacatgtgctgtgtccactcagggttgaatggattaagggcggtgcaagatgtgctttgttaaacagatgcttgaaagcagcatgctcgttaagagtcatcaccactccctaatctcaagtacccagggacacaaacactgtggaaggccgcagggtcctctgcctaggaaaaccagagacctttgttcacttgtttatctgctgaccttccctccactattgtcctatgaccctgccaaatccccctctgcgagaaacacccaagaatgatcaat

SEQ ID NO: 51852 - DNA, 1576 bp, Homo sapiens
  misc_feature (619)..(619): n is a, c, g, or t
  misc_feature (728)..(728): n is a, c, g, or t
  misc_feature (1121)..(1121): n is a, c, g, or t
aattaccttaaagtccccattctgtcttcagcctgctgtaatgtgccattgagaacctctaataatttctccatttcagttaccataaaaaggagtcaaatagaaattctagagttgaaaagtatggtaactgaaatggaaaaattattagaggttctcaatggcacattacagcaggctgaagacagaatggggaacttgaaggttaattgagattgttgactctgaggaacagaaataaaaatgaatgaaagtgaatggaatctcagagacctgtttgtggaacacatcatcaagcttactaacatacacataatgagcgtcccaggagaagaaaaacagaaaaaaggagaaagaatatttgaagaaatgatggccccaaacttcccaaacatgatgaaaaacaatctgcatattcaagaagctcaaggaactacaagtaggaaaaactgagggatccacatctaaacatactgtaatcaaactgacagaagccaaagacagaatatcttgaaagcagcaagagaaaagcaactcatcacatacaagggatcctcaataagattaatagctaatttctcttcaaaaacaatgcaggtgctggacatggttgctcacncctgtactcccagtaccttgggaggcttgaggctcaagaattgcttgaagccaggagttggataccagcactggcaatagagtaaaaccctgtctctacaaaaaatttnaaaataactgggcatgcccgtctgggatgtgaggagcgcctctgcccggccgcgaccctgtctgggaggtgaggagcatctctgcctggccgccccgtctgagaagtgaggagcccctacgcctggcagccgccccatctgagaagtgaggagcccctccgcccagcagccgccccgtctgagaagtgaggagcccctctgcccggcagccgccctgtctgggagggaggtgggggccagcccccgcctggccagccgccccctccgggaggtgggggggcgcctctgcccggctgccccttctgggaagtgaggagcccctctgcccggccgccaccccgtctgggaggtgtacccaacagctcattgagaacgggccatgatgacgatggnggttttgttgaatagaaaagggggaaatgtggggaaaagatacagaaatcagattgttgctgtgtctgtgtagaaagaagtagacatagaagactccattttgttctgtactaagaaaaattcttctgccttgggatgctgttgatctatgaccttacccccaacccagtgctctctgaaacatgtgctgtgtccactcagggttgaatggattaagggcggtgcaagatgtgctttgttaaacagatgcttgaaagcagcatgctcgttaagagtcatcaccactccctaatctcaagtacccagggacacaaacactgtggaaggccgcagggtcctctgcctaggaaaaccagagacctttgttcacttgtttatctgctgaccttccctccactattgtcctatgaccctgccaaatccccctctgcgagaaacacccaagaatgatcaat

SEQ ID NO: 51853 - DNA, 385 bp, Homo sapiens
aggcagaatgctttgactgcctgtggcactcggaagagctgcccggcccacagccctgtgcttagttagacagcctgctgtaattaagggccatgcctgccaggtcctggcccaggcaccctgagtgcaggtcatcaccactcaacactgagccccagtcctgctcccttcccagacttcctaaagcttttcttcctaaggattgagcagcttgggaatggggcccaagtggtaccaagggcactagtgcacacccccacccttagtagcccttgaactcaggcagcctcaggggtagtctcaagcagctttctcccacagccctggaaaactctaagggcaatgcatgaaggttcagctccctgggctctttggcccccttctt

SEQ ID NO: 51854 - DNA, 601 bp, Homo sapiens
atgactatttaatctcatacttgattgatagcttgactggatatagaaacataggttggaaatcatctgtctttggaattttgaaggctttgctttattgtcttttatcttctaatgttatggtgagaagtcaagtgtcagtctaacccttgattttctgtatgtgacatgtttttttcttcatggaagttttcagcatctttctgtacactcagagattctggaatttcacaatcacttgctttgatttccatggtttttcattcattttgctgaggaccaagtggattatttcaaactagaaagtcacggtcttctgaaacatttacaaattattcatatattctccttttcctcctcacccctttttactgttctctctttctggaactctttctggttagatatggtagatttgtcttccaggtttctaatcttatctgtcctgttctctacctttttgccacttattctagtaagggagatttcctcaactttatctttaaacatctattgtatttttaactcctgctgttgtatttttaatttaaagtaatcttttgtactagttatttattgttgtgtaacaaatcaccccaaa

SEQ ID NO: 51855 - DNA, 267 bp, Homo sapiens
attagatgaagatagtttctgaaagcaaattctagaccaccttcattatgaagattctatttttcacaattctaaataaagtttatttagaatttattacaaaatctatctttgctaataggtcagtgtttcttttcccaagcaccaaatacctccagaaagcctgtgtttgacccctaaattcaacattctccagaagtttgcttcaaggaatattaattctcgatggtatttgaaaaaaagatttcttgggaaaataggcaaatg

SEQ ID NO: 51856 - DNA, 434 bp, Homo sapiens
tgatttaatttcgctcccaggaagtgaatgaggtacatgtctcctctctcctcaaatctctgtaaggaaggttttattgctctgtgacctcagttctctggtgagttatgagaaaagataggactttgaagttaatctggccttttttttttttttcactgtgagtatgagaatgatgcacctcccaactctgggaagtaacgagttcttcccagtgccttaccaccaccacaatccacggacttactaccggacttactacgtgtcttatgtacctgtctgcacagtcgacttctgattgacaaactcatttcaccataaaagaagtggggtaatgggggcttatgcctcttgagtgcactggtcttagcatatcccccatcacccaggaatagcgggcataataggacgatggaatggtctgctgaagacac

SEQ ID NO: 51857 - DNA, 3646 bp, Homo sapiens
  misc_feature (1655)..(1655): n is a, c, g, or t
  misc_feature (1680)..(1680): n is a, c, g, or t
  misc_feature (1774)..(1774): n is a, c, g, or t
  misc_feature (1781)..(1781): n is a, c, g, or t
gaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacagnccaaggagacaaaagagatattggnaggaggggaaagagaagcccagacaaacagcagatgagttgagtggggcagagggacagggcagccagaccaaggccaagccttctcacccttnggccagntggaagggactttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgccccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacggtttcagtacgtgtttctcttcaataaacttcattcagtgttccagccggc

SEQ ID NO: 51858 - DNA, 3131 bp, Homo sapiens
  misc_feature (1655)..(1655): n is a, c, g, or t
  misc_feature (1680)..(1680): n is a, c, g, or t
  misc_feature (1774)..(1774): n is a, c, g, or t
  misc_feature (1781)..(1781): n is a, c, g, or t
gaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacagnccaaggagacaaaagagatattggnaggaggggaaagagaagcccagacaaacagcagatgagttgagtggggcagagggacagggcagccagaccaaggccaagccttctcacccttnggccagntggaagggactttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgccccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacggtttcagtacgtgtttctcttcaataaacttcattcagtgttccagccggc

SEQ ID NO: 51859 - DNA, 830 bp, Homo sapiens
  misc_feature (371)..(371): n is a, c, g, or t
gagccacagtctgagcgaacgtccgcgctgggagccaggggtgcccgacccccgtccgccgccgccgccgccgccgcgcatagcccccggagagccctctggggaccccgaccagaagggaccttgccctgggagaaggtaacagacccacctggggagggagacgctgggccccgggagactccgccgcccctcgcctgtccgccctatcaaaactgaaccaccctgcagggcaggggtccagggtcctggggcagcgcggggagggggctgaggcccccaaaaaccccacggggggtgggggtggggggctgggcatgggccgggcctggctgcagaagcgccacacagggagaaggccgctgggggtnggggttggggtgggcgtggatgtgggcgtgcggagaggtgggcattaacctcgctctcgccctgctcgcattcacaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgatt

SEQ ID NO: 51860 - DNA, 3525 bp, Homo sapiens
  misc_feature (1534)..(1534): n is a, c, g, or t
  misc_feature (1559)..(1559): n is a, c, g, or t
  misc_feature (1653)..(1653): n is a, c, g, or t
  misc_feature (1660)..(1660): n is a, c, g, or t
gaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttgnccaaggagacaaaagagatattggnaggaggggaaagagaagcccagacaaacagcagatgagttgagtggggcagagggacagggcagccagaccaaggccaagccttctcacccttnggccagntggaagggactttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgccccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacggtttcagtacgtgtttctcttcaataaacttcattcagtgttccagccggc

SEQ ID NO: 51861 - DNA, 2932 bp, Homo sapiens
  misc_feature (1655)..(1655): n is a, c, g, or t
  misc_feature (1680)..(1680): n is a, c, g, or t
  misc_feature (1774)..(1774): n is a, c, g, or t
  misc_feature (1781)..(1781): n is a, c, g, or t
gaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacagnccaaggagacaaaagagatattggnaggaggggaaagagaagcccagacaaacagcagatgagttgagtggggcagagggacagggcagccagaccaaggccaagccttctcacccttnggccagntggaagggactttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggccccgggccattcaacgcctccgggccattcaacgcctccgggccattcaacgcctccgggccattcaacgcctccgggccattcaacgcctccgggccattcaacgcctccgggccattcaacgcctccg

SEQ ID NO: 51862 - DNA, 225 bp, Homo sapiens
  misc_feature (1)..(1): n is a, c, g, or t
  misc_feature (195)..(195): n is a, c, g, or t
nggacccttgaatgcagaagttgcaagtttcacagaaccaagtattcctgatgctgatcaagatgtgctccctccagcaccatccaaaccctccacatccagtaacggcaggaactgatctcaggcctaatggtgcgggcatccacactggctcttgtgcttgctgacggcccggggaattcttggaatgggtgnggcagaggttcccttgctcacagcctccct

SEQ ID NO: 51863 - DNA, 377 bp, Homo sapiens
ctttgaaggtatacaattcagtgtttttagtatagtcacagattagactgtgaattctgtacccatcaccactatcaaatatcagaatattttcatcaccccaaaaaagcaaacccaaggaccgggcatggtggctcactttgtgaggccgaggcaggcggatcacttgaggtcaggagtttgtgaccatcctggccaacatggtgaaaccccgtctctactaaaaatacaaaaattagccgggcgtggtggcacacacctgtagtcccagctacttgggaggctgaggcaggagaattgcttgaactcaggagtcggaggttgcagtgagcagagatcgctccaatgtactccagcctaggcgacagagcgagact

SEQ ID NO: 51864 - DNA, 813 bp, Homo sapiens
tgtttcttcttctgtaaaatgaggcttatcatgttacctacatcatagggttgttgtgagaataaaatgaggtaggtagtgctggagcatagtaagtgttcaataaagccagtcattcttaggaacagagcagccttgtttggagactagacatttcccattgaagtcaggctaccaagaggcatatttattttccagcaggaaggcagctggggatgggccggttacatccatttgatgttgctagagcatcccagctactcaccacaacccctcctccaatattcacttcataagaacctgtgggaatccctgcaacatttaccaccttctccaaccctggtgacccattcttagacaagcttggctaaataattcccttcctgccatcctcacaaccagtgaggtcaccttgtttgagctgtgttcatttttggagttaatgtcattttgaatcacatttatgaggaaagaagggtgggggtagatgataccattggttggacttcagttgccatatttaaactttcatttccaaacctttcttttgattttacgtttttgtctatgcttattacgtagccttcacagggatccaattgctgggctgaaatttttgagctttgactgaaagaatttggcttttgggtggggcctttacctgtggttgggaaactcagccgtggcattgcagatgggccagtgtttaaggtcagatgtctgtaggtgactgtgctgccatttcatagaatcaaagagagggacatggcttcaagggttgtctggcccaatcccctgctagcaaaaaaaaaa

SEQ ID NO: 51865 - DNA, 456 bp, Homo sapiens
tttctcaaaatatgctgtgagaaacactaactttgcaggactcttaatgggtaagaaagatttgaagtcaagtatcttgaaaatattgggttaaacaatttttttgaaagttacaggtatatttggagggggggcaattatagaatgcctcagttttttcaaaaaatattccatgtattatgaacaacattttctaaacattttagggagcagcacttagagctagccttctttggcacacagtttaaggtggtagtcccttgtggaacagacagcttgaaaacttttcttgcttctctcttaggtttatgtgtaaacttctagttctcaactctattccctacaatactttgtttagtcactttcttaaaacttggcacttgtagaaaagattaatagtttactttgtgtgaaaactcgtggagacactaagtttgataagttgtgggttatttc

SEQ ID NO: 51866 - DNA, 253 bp, Homo sapiens
acaatggactgtcagagcagccagctcctccctgctgctcacaggaagagccatcaacaaagccaatccctggagataggctctgaaaccaggatagagactccttcaatgctctgctggttccaccatgtatcatcagagaatcaccctgagtggcataggtggcctgggatctgggcacagcaattccacacatcttcacctagaaaccctccttctggctgggcctgatggctcatgcctgtaatcccag

SEQ ID NO: 51867 - DNA, 467 bp, Homo sapiens
aaatcattatatttgtattatacagaaaacagccataagcaaagaagaattcgagcaaaaatcaaatttttcaaatcaagcaaaagatataaacaaagaatccacaagaaaagaaatgtaaatggccctcaattgtatggaaacatgctcatctttattaataatatgagaaatacaacttaaaatggccacttattaaattgaaaaaatctcagtacttggattgcacactgtgtagaaacagtcagtcttttatccgtctggtgagaatgcaaatccctaatagagtggaacttggcaactcaccggaaaattccatgcgcatttattctttgccaattgatcttacttctaagactctctccaaagaaatactggaaaaatataaaaggaatcatgcaaaagagaaatataaatggatttacttagtcccttgcatcatgaaaataagcagtggaaagaccagc

SEQ ID NO: 51868 - DNA, 427 bp, Homo sapiens
tgatcacaagtatcctatgagataggcgaagcagacacattgctagtttactgaaaattaagatccagacaagttaacccagagtcactctgtgtggaagtggcaaagttggaaaccaaacttaatttttttaaattaatatttatgagcatttaccctatgctaggtcctatactagttacacagtcatgtatggtatatgccatcacttctgatctttgtgtcatttgtgaccttgtgtgtatcagccaggcgcagttcactggtgaacacctaaacttgaaacgtgcggtctgggtgcgatggttcatgcctgtaatcccagcaccttgggaggccaaggcgggcggatcacgaggtcaggagatcgagaccatcctggctaacacggtgaaaccccgtctctactaaaaatacccaaaaaaaa

SEQ ID NO: 51869 - DNA, 205 bp, Homo sapiens
ctttgtctcgctaatgatttcaattagaaggttatagtttgagattttcaaatatgatatcccttgttctatttgctttgactctttttttggacagctttcctcagatttctggtttcttgattttctacttcttatttactaaaatttactaactaggaattttgtgttagtggacaaaatttcattatagggtaattagaaa

SEQ ID NO: 51870 - DNA, 473 bp, Homo sapiens
gccaccatgcccggccctagaatcctattttttaaaagcaactaggagtatatctaagatatagcatttctctgtctgagagcagggagagcttgcataggtgtcaatgtccttcaagggactcttgaaactaattcagggccctatacactgcaggcatttcttggagtggccaaggtattgtcatgtgttaagaattctgagaagttctcggataatgaaatttgtgcagctttctttaattcagcagttttcaaacatctaacaatagaatccttcttgtctgaggggcctcgccttaggaaaggctgccctaacaacctcaaagttcccttccaacacccacagtccaccattctagtcttggctctgccactaacttactgtatgactttggccgaatcacctttcctcttggggtctcagtttgttaagttattaacaccctgggtgacagagcaagaccctgtctc

SEQ ID NO: 51871 - DNA, 208 bp, Homo sapiens
aaaataaaaaaacaacaacaaaaaaagatgttttgctaaaatagatgacatcagataatttaataacatcaatataagaaaaaatatatattatttgcataatggaataaaaaggtatcagaaattattggcaataataagatgtgcgcatcctcaaaaatatatctacaaagtatgtcattttaatttcagaaatgttatattttta

SEQ ID NO: 51872 - DNA, 601 bp, Homo sapiens
cacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaatgggtgtgtctagaaggggcatcagttcatcgggggagaggtgtgcacctgtatgtggggcaggagggtgtgcaagttcctggaggtgggttactccaaggcatgggcagtgcagagggagcctcgcctgggc

SEQ ID NO: 51873 - DNA, 740 bp, Homo sapiens
gtggagtcttgctctgtcgcccaggctggagtgcagtgatgcaatttcggctcactgcaacctctgcctcccaggttcaagtgattcttctgcctcagcctcccgagtacctggaactacaggcacacgccataacgcctggctaatttttatatttttagtagagatggggttttgccatgttggccaggatggtctcgaactcctgacctcaagtgatccacccacctcggcctctcaaaatgctgggattacaagcgcgagccaccctgcccggccgaaaagatctcaaacattcatctcttacaagatttagatgactatcatcaatatgccttaacatcagtagtttaggagactctagcccactttgtctagttgcaaactgtaattctccctgtggtcccactgaatatcattccacagcattcttggatatatatgatgtattgacaattcaggtctagatagaaatggcccctattgcttcatgaagaatatcctttccccaaatgtcttctgaggagctcaagattaaagctagtatcctgtacagacacttgcaggactgctagtatgatatatattgaccctatgggagacaaaatgtgggcaaccacccctattctgggatccttaaaagatgagaaccatatcagaaagttccttcacagctacccccaactaggtcagggaatttgatgcctgggcttatctagtaataaatattcaactttatg

SEQ ID NO: 51874 - DNA, 186 bp, Homo sapiens
ctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccagg

SEQ ID NO: 51875 - DNA, 334 bp, Homo sapiens
gcaagagaacctgatataatatctataaattttgattccctggggtataacaagtaaataatttttaaatggtgcttagcaagattggttcatggaaaatgaagcaattatggcttgaatttatatgtacaatatttattgtcttaattttaatttaaaacgaatgacatgtctctttttttaaaaaaagtcttcttttaaagatcttgtagttgatgtgatgagctatgcactgctaaatatttatccacacataaatatttgaaaaggaatatgaatagtcatggatgtagtttcatctcagtgctccatggaggaagtgtttcacctctct

SEQ ID NO: 51876 - DNA, 2871 bp, Homo sapiens
atgccccgcgtctcggcgcctttggtgctgcttcctgcgtggctcgtgatggtcgcctgcagcccgcactccttgaggatcgctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttctcactccagagaacggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcgctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtagaattggaaggtcttaccggccacattgaattcaacagcaaaggccagaggtccaactacgctttgaaaatcttacagttcacaaggaatggttttcggcagatcggccagtggcacgtggcagagggcctcagcatggacagccacctctatgcctccaacatctcggacactctcttcaacaccaccctggtcgtcaccaccatcctggaaaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcattcatatgggacgcaaacccggctatttctccttcctggacccattttctccgggcgtctggctcttcatgcttctagcctatctggccgtcagctgtgtcctcttcctggtggctcggttgacgccctacgagtggtacagcccacacccatgtgcccagggccggtgcaacctcctggtgaaccagtactccctgggcaacagcctctggtttccggtcggggggttcatgcagcagggctccaccatcgcccctcgcgccttatccacccgctgtgtcagtggcgtctggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggctcggttttccgggacgagtttgatctggccattctccagctgcaggagaacaaccgcctggagatcctgaagcgcaaatggtgggaaggagggaagtgccccaaggaggaagatcacagagctaaaggcctgggaatggagaatattggtggaatctttgtggttcttatttgtggcttaatcgtggccatttttatggctatgttggagtttttatggactctcagacactcagaagcaactgaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtag

SEQ ID NO: 51877 - DNA, 1303 bp, Homo sapiens
aaggccaggcgtggtagcatgtgcctgtaatcccagtgctttgggacaccgaggcaggaggatcactcgagcccaggagtgcgaggctgcagtgacgctagacttcaggaagaccccccatttctgctcccctcctgggcttggagaagagtacagctgctcttgactggtgggaccttttgctggctaggggtgatgggagaagcaagagagggatccacacacctgcgcttagctttctatgacctgggcggatggaggccaaagctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttcacaggccagcggggaagcatttgaggctcaaataatgatgaccgtggagagattttactaggggcggctgaggctgctggacagctctcagcagaagttggccaagttcaccaagctgcattcgactgcctgtttctctgagccatcttagccacacaagcctgcagttatactgcattgacttctaattccttcccacctgctgcaccctggtacttgctgtgactccttttctgggttcttcatgctgaacagatgcgatgtgaggcaaacctcagctctctcatgttctcagtgaagtgctcagttttgcctggcgcacagttggtggtcagtaaattgtagtagaggagtagaggccggcagta

SEQ ID NO: 51878 - DNA, 455 bp, Homo sapiens
tccgcaggcattgaggtggataatctgagccctggggtggaggcttcagtgagccgtggtctcaccactgcactccagtctgagtaacagagtaagactctgtctccaaaaaataaaaataataaataataattattaactagtaacagttggttacctactaaaggggtaaacaggaaaacaggaatagcaaatgaaagaaacagctgtggcttccaggtgatgggtgaacaagggtggaaataagcatctggggggctgcctgctggctgaactccagggatctgggcagagtgtgtgggagtcttgggaatattcaggattcccccaaccttagtgctggggaaacaggccagaggcaggcaggcctagcagctctggaggggctgccgttggagccgagcaactccctggaggctgccctgagaccctcgtcctggaagtgatctctcacc

SEQ ID NO: 51879 - DNA, 374 bp, Homo sapiens
ccaaatagaaacagctctgctctgcacctcccaccaagaaggatgaaaactgcgagtgaattctgcatcttcaattgaggtaccaaggttctctcattgggactgactaggtggttggcgtgacccacagagagcaataaaaagcagggtggagtgagggcccacccgagagctacacagcgcaaagggagctccctcctccagctaagggaggtggtgagggattgtgctagcctccctgaagatcatgcttttcccacggatccttgcaacctgaggatcaggaggtccccacgtgagcccacgccaccagggccttggatcccaagaacactgctgtgcagactcacagaggctgcgcaagtgggcagaaa

SEQ ID NO: 51880 - DNA, 329 bp, Homo sapiens
tagaaaaagctccaaaaattagattccggccctcaaaccccacaacaggacttaattaacctcaccttcaaggtgtacaataatagaacagaggcagccaagtagcaacgtatttctgagttgcaattccttgcctccactgtgagagaaacctcagccacatctccagcacacaagaacttcataacgcctgaaccgcagcagccaggggttcctccaggactgcccgccccaggatcttgcttcaagtgctggaaatctgccactgggccaaggaatgcctgcagcccgggattcctcctaagccatgttctatctgtacgggaccc

SEQ ID NO: 51881 - DNA, 372 bp, Homo sapiens
ggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatggga

SEQ ID NO: 51882 - DNA, 620 bp, Homo sapiens
tggtacatcctgtccctcatatcttcatgactgcaacatttactgtacttgattgcaaagtcttacagatgtatgactgattaaccgtactatgtttatgcaatcatccccttattttttagttatcttaattcttccctgtatgtactgctacttctgtgagtgtccttggaacaatttggctggtcatgtgcccagatgacatcaagtggacaagtggatcaagggcagttttctaaaaatgtgtgtgtatgtagagggggtgagtcaggagcctgttagcatgagctctgtgttgggcactgagatcctgagtgccagttctctgctgtccttgaaaactgctcctgacacaggggcattttctttctttggcctaaacctgtcttttttggcataaaccctgtgcaaagctcggtccataatagtttataaataaaccctggttattaattgtttatacccatatttttttgttttggttctgattttgtctaaagaaaggggatcttggctccctttaatgtccatatccaatcatcttccattggcagtacctaattttgaagaaggcaacactgactgagggaattaggaacagttttagttgatagttatgt

SEQ ID NO: 51883 - DNA, 398 bp, Homo sapiens
ttttggggggaatcctggatcctcttctgcagggaccccagtcctgagaggcccagcctggggcttagtccactattctgagcaaaggcctgtggagatcagggaacaatggagttttcacccaggtctgacttagtgggcatgataggtccagaatctatgtattgtcatttcttaaagttcgaaagcatcattgaattgacacactcagcaaatggaagcagccacatattctgcactcctggacccggggagtgtgggccattatggtggcaaaggtgcaggggagtcctggacctgctcctccctgtgaaaacgttgaaggaagcaatgccaagctcctggagaaatggaaaggtgcagagagggcatcaggcacttagaggtgttggtgacag

SEQ ID NO: 51884 - DNA, 253 bp, Homo sapiens
gagaaggacccctgagtcctcaaatactctggctgggcctggagtcagctgcggaggggcagagatctactgctgggtgctctgtgaccttgcgctagttccttaaaccctctgtgcctcggtttcctcagtaacatggaaatggtaatagtccttccatcatagtgttgtttcgagaattaaatgagataattacataaagcacctagtggctggcttaggaaggaactcactcactttttttgagatggag

SEQ ID NO: 51885 - DNA, 290 bp, Homo sapiens
ggaacttctgtctcagtgttcagtttttacttagtaccttgacactactcttagttcctggctctactggtataattttgggatttgggggtgtatctatttttttgtgcctcagttcttctgaccctgtccccgcacccctctcccgccccccatttcccaggactgtggacctatttcatttcttcaagaatgaaatttccttcttccactatgcaataccccgttctagaaatttgcctttcatctctttccttgaatcagagagctgccctgtttttgcaagattt

SEQ ID NO: 51886 - DNA, 341 bp, Homo sapiens
gctccctagatactgccttggaatgttactcttggaaaacagtggctacagagtgatgcctttctccataactttaatttaccttaagaaaagctttgagtgctactgagtcgggaatgaaaaacctagagaatgttctgtcctgtgggagcaaggagtatagttagtccctgtattactacccaaaggggcatgaggcttcaccctccttgggctccctagggacttataatgccttcctgtaattatcgggccagttaatttaatactaatccacttaattcagttaacatcagatttgtcctagggatcttgttacatccttttgtatactaaaagag

SEQ ID NO: 51887 - DNA, 8244 bp, Homo sapiens
  misc_feature (6424)..(6424): n is a, c, g, or t
agcggagtgctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggtcacagcccgaggggacctgcggacaggacgccggcaggaggaggggtgcgcagcgcccgcgcagagcgtctccctcgctacgcagcgagacccgggcctcccggccccaggagcccccagctgcctcggccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcagctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctngagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctc

SEQ ID NO: 51888 - DNA, 3554 bp, Homo sapiens
  misc_feature (1848)..(1848): n is a, c, g, or t
ggcacgagcccaaatccagaggcagaaatctctagaacttcttctccagaaggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctngagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctc

SEQ ID NO: 51889 - DNA, 7290 bp, Homo sapiens
  misc_feature (5684)..(5684): n is a, c, g, or t
gaagcaagggctgaagactccctggtctctttctctccatggcccaaggagaacagtcaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcagctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctngagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagacattgatgagtgcctctcaagcccttgtctgaatggagccacctgcgtggatgccatcgactctttcacatgcttatgccttcccagctacgaaggggacctgtgtgagattgaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctc

SEQ ID NO: 51890 - DNA, 499 bp, Homo sapiens
ggggaccctacaccgtccacagggttgagcaagggaagggaggtcggggggctgctcagtcacaaatagctgaccactgcccttagaagggccacgtacttgtcccaggagagggctcacttggaggatgaaggagaaaaagccagaaagtccaagaaaaatccaaatcaggaaagccgataaagcctcaggcgcctgagtcctggtttccacaagggagagagggtagtctggggagagcctgggctcgccccactttctttccaggtccactgatatctttccatctccctttcgtcctagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaa

SEQ ID NO: 51891 - DNA, 7947 bp, Homo sapiens
  misc_feature (6424)..(6424): n is a, c, g, or t
agcggagtgctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggtcacagcccgaggggacctgcggacaggacgccggcaggaggaggggtgcgcagcgcccgcgcagagcgtctccctcgctacgcagcgagacccgggcctcccggccccaggagcccccagctgcctcggccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcagctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctngagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctc

SEQ ID NO: 51892 - DNA, 7390 bp, Homo sapiens
  misc_feature (5684)..(5684): n is a, c, g, or t
gaagcaagggctgaagactccctggtctctttctctccatggcccaaggagaacagtcaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcagctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctngagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctc

SEQ ID NO: 51893 - DNA, 7618 bp, Homo sapiens
  misc_feature (5684)..(5684): n is a, c, g, or t
gaagcaagggctgaagactccctggtctctttctctccatggcccaaggagaacagtcaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcagctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctngagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagacattgatgagtgcctctcaagcccttgtctgaatggagccacctgcgtggatgccatcgactctttcacatgcttatgccttcccagctacgaaggggacctgtgtgagattgaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctc

SEQ ID NO: 51894 - DNA, 676 bp, Homo sapiens
gagccacagctgacttccagatcttgtcctctttgttgatgtttctccctcaaaatgcaattcatgaggaggtcccagggtgagagcgtgtttgcttctggcgtgttctggggtagaggacagctctctgcctgatgtttgagcctcacgaggaagagcatgggagataccgttcatctcctaagggtgaggggtcacccttctggagtgaggggccacgggtcacaactgagggccactcacagtgcttatgcagaggccaggccaggtgccaacagtgggagtgggctgtttagtgagggctcctttggaagcccagaactcacaagttgcctcaaggaagcagcagtgaatgactgagtagtacctggtattcagaaggaagctgcgtacgtagccatgcagataccaattgctggtatgtgggtgggagttcttctgatccagcctttctaggttgggaactgtttccaccctgaaagaaactgaatgaaaaatgcctttttggcaatactgaagatatcttgaacattgattttggaaattaatttttattaatctacccagaatcagtatcgacttgctttatccacacggcagttctttaatatggttgatttaaaaatacagatatgttcattagaaactggaataagatcacgttttcagtgatcat

SEQ ID NO: 51895 - DNA, 352 bp, Homo sapiens
tttatttcaaatgaaagtgttcagagatatctgaggatgctattaacatgaataattgtgtctcttcagaaagaactgtgtgactaaagaaataggcactggagaggccactgagggactttctagaactttcatatttaaagatgtttaaagggaagaatggatggtttttaataactgcaattaacagtttaaccatgttcttataggctggactaaacagtggtatcttgagatctttttaagttttgagcaatcagagagaaatgagttttagagcaatataaattgaggtttataatcgagctacaatgaaaagtctcttgatttctagctcagaatggttgagtaa

SEQ ID NO: 51896 - DNA, 354 bp, Homo sapiens
cagagagaggcggcagctccgggcgggatcaggcatgctcttcaaactcagtcagccagtgctggatgcctgctggatgcagacgccatgccggcaggtggcatgctgcagggagcacccgagaagacgaggcgctcagcctgcccgacttctctcagcttgcctcctccctgcttgtgccaagctctagttaatgaagcttggagcacgccagtgggttttaaaaactaatgaccaagaggaagggaaaattccttacactttccagtcatttgactgcttccctcttgggtgggtgccacactgtgacatggagagcatgactcagaccgactgcttgcttccagcccgtgc

SEQ ID NO: 51897 - DNA, 120 bp, Homo sapiens
gctgtgaatgaagctggcagacgctcctactagacgttacactcacgggaaccagttcagccctgtgctcagagcttcacactcaggggcctcactgatgcctcatgaccactaccggag

SEQ ID NO: 51898 - DNA, 364 bp, Homo sapiens
gctaagggggaaaaaacttttttcactcccttacatagtcactcttaacacagtacagaatatttcacctctggtcatcaaaatgtgtgaggcacacacaccaaggaatgctccagaggccaccagctggatatcctataattcaattctgacactatttacctaaagatagcatcagatctcacaggttaagggctcagtaccacaaggctgcttccacttcagattccaattgcaaggcacaggttgtgacctgtgcttctgattgatttgctataaattggtgttccctggccaggcgcggtgacgcacacctgtaatcccaacaccttgggtggggcgaatcgcttgagcccaggagttc

SEQ ID NO: 51899 - DNA, 371 bp, Homo sapiens
tttgtatttttagtagagatggggtttcaccatgttggccaggctggtcttgaacctcaagtgatccaccctcctcagcctctcaaagtgctgggattacaggtgtgagccaccatgccaggccaaactatcttctctttctcagaccttgaaaatctgggctgctaggctttgctgatttcataaaccctaataattaacgactaacaataaaagatatctatttaaggtaatatatgaggggactgggcaaggatctaacctctatctatgtagatccaatcccaggttctctaaaggcccctgaggaatctctttcactgaattatgtgacatcaggttcaatcaacattttcaatagcattgtagcc

SEQ ID NO: 51900 - DNA, 341 bp, Homo sapiens
taatatgcctcctgcttctagggtagcagtgcccacccccagcaccattgtagttcattttccacacggcagccagagtggattttataaaactcaagaatctgatcatgatcatgtctcttctgataatgacctggtttataactattgtcctggaacactctcaaaaatgtaatagtatattgtcttctagtccctgtttgtcatatctgtgatagtgggggaaatgattctgtgttcctttgactaaaagtttattctaggacaggatttggggttggtacacactgtcaattccaggaagtcttgcaggtgataatgttgcaaaacaaagcaaagaa

SEQ ID NO: 51901 - DNA, 254 bp, Homo sapiens
caagaacacatataagatttaacaaaaaattggaacatggaagaggaaagagagagaagtgccaggaactttaaatcagttggttctgtaattgcacactacatttagctgtgagttttctggccaagggaaaataggacccacgtcgagttatttagatatcttgtttggagttattatacttctactggttggacgcagtggctcatgcctgtgaaactagcactttggaaggccgaggtgtgaggattgct

SEQ ID NO: 51902 - DNA, 462 bp, Homo sapiens
gaatatttgctttcattctgtcccattgttaccctggttcttccaagcgtccagcttacctgccgagcttctttcagtcatcctctggtgtcctctgacaattgtcctctgcttccgcatgctctagcgttccttcacaggggttttcgttgccccacattgggtgccagaaatgttggagtgatcagacccaacaccaggctgtgggggctacaaagtctggcagagtcgaaggaatgagacaagacaagaatgcataaagtgggtccagggggccaacaccagtatggcagctgcgaaggccctgagctctgggagcccacgctctttattggtgatcaaacagaagcaggtggtgaggacgtgaggacatggggttagaaaggaagcggtgcatcaagcgtttgacctatagctgtggcagtttagcattttcttttaagcatatggaaaaccccctgt

SEQ ID NO: 51903 - DNA, 793 bp, Homo sapiens
aaaggatcaagcatccctgagtttcaaacagaaacttgcactgaatacattcaaagaaccatcaagaaatggggacctggattttatttgcctgcctcctgggagcagcttttgccatgcctctaccacctcatcctgggcaccctggttatatcaacttcagctatgaggtgcttacccctttgaagtggtaccagagcataaggccaccgtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcattaaaaatca

SEQ ID NO: 51904 - DNA, 316 bp, Homo sapiens
cagctcttcagactggataatttctttggatctctcttcatgttcactgattcttctgccatatccaatctactgctaacttcatccagataatttttcattttgcttattgtgctttttagttgtaaaattttgatttggttctatcatattttcccatttctttgtatgtctattaatattttattgactacaggacattttagatatgtggtatagagactctggattttgttatcttacaccaaagagtgttgcccctgttacagcaagcagttcaggtactggctagtcaccttgaacgtgtgtgggtttg

SEQ ID NO: 51905 - DNA, 826 bp, Homo sapiens
agccccaccactgagggctaaagtgctctggagttctaaatgaacttgaaaggccacaaggcctgcaattcctgtgcaagtcctagtgctgcactgggcttggagccactggacttggggtgcacacgacctagtgaaatactagctggggtggccaaaggagtgcttgcatcaccactcctccaactccagacatcacagcttgcagctccagcagaagagggaaaagtaaagaggatttttttcttgcaacttggatcccagctcagctacagtaaaataaagcccccattctagaccatagcttctggatgacatttctagacccaccctaggccagaagggaacccactgccctaaagagaagggtacactcctagcagaattcaccacctgctgaccaaagagccattgggttttgaataaacatcagcagtagccaggcagtagttgccatgggccctgggcaagaaccaaaactgtgctcatttcaggtgtgacccagcacaattctcatctgtggtggccatcaggagagactcctgcttgagaaaaggagagggaagaataaagaggactttgttttataactcaggtaccagctcagccacaataaaataaagcaccaagtagactcctaaagattccaggctttggctcctggagtgcatttctagaccccccactgggccagaatggaacccacgaccctgaagggagagacccagtcctggcaggattcatcatctgctgactaaagagcccctgggcttgaataaacatcagtgatagtcaggagatagttgccacaggccttgggcgaaac

SEQ ID NO: 51906 - DNA, 633 bp, Homo sapiens
  misc_feature (7)..(7): n is a, c, g, or t
  misc_feature (112)..(112): n is a, c, g, or t
  misc_feature (129)..(129): n is a, c, g, or t
agatggnccaggtaattctaaaagtccgggtattttctgcttgcttaactttctcaggctgaatcccttaagacacccgtgtgacataaatacccttgtccgtcttgtcttnagagaagggattctggnaaggatcctggtcgattccacctccaatgctgaaacccaggattaagttctcaccttgacgaattcaccacctgctgaccaaagagccattgggttttgaataaacatcagcagtagccaggcagtagttgccatgggccctgggcaagaaccaaaactgtgctcatttcaggtgtgacccagcacaattctcatctgtggtggccatcaggagagactcctgcttgagaaaaggagagggaagaataaagaggactttgttttataactcaggtaccagctcagccacaataaaataaagcaccaagtagactcctaaagattccaggctttggctcctggagtgcatttctagaccccccactgggccagaatggaacccacgaccctgaagggagagacccagtcctggcaggattcatcatctgctgactaaagagcccctgggcttgaataaacatcagtgatagtcaggagatagttgccacaggccttgggcgaaac

SEQ ID NO: 51907 - DNA, 368 bp, Homo sapiens
aggaatttctccacacagaagaaaaataccagatggaaatgtgcatctacaaaaagaaatgaagagtgaaagaaatggtaaatatggccaggcgtggtggctcacgcctgtaatcccagcacttaggaagaccgaggaaggcgaatcacctgaggccaggagatcgagaccaacctggccaacatggtgaaaccccatctctactaaaaatataaaaattagctgggcgtggagatgggtgcctgtagtcccagatactcaggaggctgaggcaggagaattgattgaacctgggaggcagaggttgcagtgagctgagattgcgccactgcactccagcctagatgacagagcgagaccctgtcgca

SEQ ID NO: 51908 - DNA, 350 bp, Homo sapiens
cagctctgagggaacaaggatctgagaaagggtgatggctgtggggctgcaaggtagagcatacggatgttatatatatattttaatgccttaaatggttaaacagttcagtctgcacaattacataatataaagccacatatctaatctattaaatgcaatgtattttttttattaatgatctgttcaaggtgtagtcataatgtcttcaaaagggcttgtggaatctccgtttgtatcaaaaccaggagaaatctcttcaaaatctgaaattcgtccagatttactccacataaactactttttgacctttcatcttgagaaaagcataatttctgtctttggtggga

SEQ ID NO: 51909 - DNA, 641 bp, Homo sapiens
ctataaaatctgagcattccctttgttctctggagcaaacaatgttaagttgttaactctctgtacctttctctagaactggatggaaacaactccatctgaaatgcagccctaataccagggaactcctacagtaaagcgctaaacaactttattactctaaccaacgtttatgtccctaatcagcaagaagtagttagaatggtcatcatccctttccctcaagattgaggaatggacataaaaaggaggggatttgtaactgctccagactgatctgttgtcagaaaggggctcttgaaccagaccatgaaagagggttcttggatctcctgcaggaaggaattcaaggagagtcacagagtgtagagagaatagacagtttattgaaagctactcagttacagagtagggcatcctccaaaagcaggaggaggaatgtgctgtctttgttttaaactcttcttttataggggtttaatctatgtaaaacctaagctatgtctacatgtgggtaggctgtcagtgtgacaaaatttagtattttgttgatataaagaaacttatccttgtcatcttagtgcataagtacatcaaagtatgactttagctaccttaaaagcatgtattgttatgtgata

SEQ ID NO: 51910 - DNA, 328 bp, Homo sapiens
agagactgttatcatactcattgcacagatgagaaaatggaggcagagagggaggttcagtaatttgcctgaagtcaaagagtagggtaccagagacgggctccagattttgttgctttcaaccacttgctatactgccaaggtggaattttgcatttcaaagaatgcctactccctcgctttggagagagtagtgttttaatgatgtctgcactgtggacatttttcctgtccttaccgctccagaaactagtagagctccctgtccaggtgtcttcgttacacatgtgccttcctagtctggagtccacggcttcaagatcctctc

SEQ ID NO: 51911 - DNA, 336 bp, Homo sapiens
gaacatcttcaacctgatgaagggcatccatgagaaaaaaaatgcaatggatatcatatttagtgaaatattgactactttgcccctaagatcaggaccaaggcaaagatgtttgctcttaccacttctattcagccttatactggactagagttctggccagtgcaataaggcaagaaataaaaaggcataaagactagaaaggaagaaataaaactctttacagatgacatgattatgtggaagatcctaaggaatcctaaaaataaattattaaaataaaagtgactacacccaagtggatttggcagggtcacaagatacagtcaatgtaca

SEQ ID NO: 51912 - DNA, 783 bp, Homo sapiens
agtctccatttataagcttgtctctctgcatcaggaagaaaagaaggactaaatcaccagacactcttaaccaatggagaaggagtttaagtaacaaaccttacctttgtttaaggtgctttttctggctctctgccattaagatctacattttccaccctgtctcctctaggacctgagggttatctctttgatatgcaaatgccagggagattactcaccagaagaagaagaagaaatagagctaattggaaattgagcaaataaaaaaatcttgttttttctcccagaaacagtgaaaagctttagccatcctttagataatcttaacttgttccatctgccagaaacacaatttggattcagaaattctttatgaactgtttttgtattattgtacctggcacatggctacagttttcaaatgaaaactgtgaaatctgcttctgtctgtattttatgtatgtctgtgtatgcatgtatgtgtaatatttttctacctctagagactatcctaaaattaacttataaagagctgtatttaattgccttaaagaaaaagcacttatacaaattaagtattttttaaactttcagaaaaataagacctagcgcaaatgttcttcaagttgatattgttaaaagaagaaacttcagccaaattaaacttaaagaagtttaattgagcaatgaatgattcacaaatcaggcagcctccagagttacagctgattcatggagactccagggatgcctcatggtcagaacaaatttatagacaaa

SEQ ID NO: 51913 - DNA, 284 bp, Homo sapiens
tggtacgaattttagacggcttctttgacagacttttctgtgggcctgtccctgtggactggctttctgtctgttctgctcttgcccattcacttattcatatcctttgtaactctgaagggcatctgcccttgactctggccttgggggacttggtgaatgtagggcccatctgggctaagggtcagagttaagtcttctgatgttggtaaaataagacagttgaagccttccccccttcccttttatgcctccaaaaaaaaaaaccaaacaaacaaacaagg

SEQ ID NO: 51914 - DNA, 626 bp, Homo sapiens
atctcagaggctgactaccatagtaagaaatatgaaggttaacttgaattctaccactcttatgaattttgaatttgttactgatgttcactaaaaagtgctttgcaaattatgaggtgaacatggtggaaaatagaaatagcatttcacaaaaagtcctgatcagtgtatgaataacatcctctgcttcgaaatattatgaacattgcatatcatcacattagatagcttttggtggggcacgagatcagataattgcaaagaaaagatggagaaaaggtaaagactgaaaaagaaaataccaaagaccagagaaaggaaaaagaagtagaaaaagagaagataaaggaaaggggataaaagggacaagacaagacaaatcagaggtagaagagcagagacacagaagataaaaacatgcaaataaaaggcaaaagaaatgtgaacccagaggtgatctgaacaagagagaaggaaaaggagaaatgatcgtgaggggggggaaagaaaaaaaaaagacagaaaaaaaaattaaggttttcattcctttaccagtttttagatccttttccacctcagaacaggcttgcagcctcttattttctgtgtttcctcgtgctcctctg

SEQ ID NO: 51915 - DNA, 680 bp, Homo sapiens
atctcagaggctgactaccatagtaagaaatatgaaggttaacttgaattctaccactcttatgaattttgaatttgttactgatgttcactaaaaagtgctttgcaaattatgaggtgaacatggtggaaaatagaaatagcatttcacaaaaagtcctgatcagtgtatgaataacatcctctgcttcgaaatattatgaacattgcatatcatcacattagataaagcatatacataagtattgtcaaatctgcttcataagattataaacatcttttgcttttggtggggcacgagatcagataattgcaaagaaaagatggagaaaaggtaaagactgaaaaagaaaataccaaagaccagagaaaggaaaaagaagtagaaaaagagaagataaaggaaaggggataaaagggacaagacaagacaaatcagaggtagaagagcagagacacagaagataaaaacatgcaaataaaaggcaaaagaaatgtgaacccagaggtgatctgaacaagagagaaggaaaaggagaaatgatcgtgaggggggggaaagaaaaaaaaaagacagaaaaaaaaattaaggttttcattcctttaccagtttttagatccttttccacctcagaacaggcttgcagcctcttattttctgtgtttcctcgtgctcctctg

SEQ ID NO: 51916 - DNA, 442 bp, Homo sapiens
gctcagacaggctgaaaatgtgttcaagcttacatgatctggtaagtcagagccagcctccgagccaccggcttcctctgaagcctgagttcctacccattctgctggctgtctcccgagtactgtgggcacatgaggccagagatctcagaattcagctgcactggaatcccctggagggctggctgaaatgcaggttgcctgctcccactgagttgcttactccctagggtgcagtgggccggagaatctgcatttctaactagtgttcaggtgctgctgctgctgctgctgctggtggtgggtatccattttagggaccactgcttgaggctgggagactggctggggcaggggacactgaggtctcattctgattcccctgggacctgagtgagctcccctgagcctgctggtgaattcccattctggctgttcatgt

SEQ ID NO: 51917 - DNA, 327 bp, Homo sapiens
tccatcaggaatatttaaacaaagttcactacttaaacaccatctaaatatactttttgttatattcccagcagaaattgatggcaaggaatcatatatcccatcaaaaccgtatttttccccctaaaaggcagtttagatgttctcattctaggttttccatctctctcctccaccattccaattcccagagtacctctacaaatatccctgcttaccagtagaactatttgctttaacaatctttctgtgggtaaggagatgcatatgccaatgtgaaaactatggaggggactcctgccttcagagctgactagaaacattgaa

SEQ ID NO: 51918 - DNA, 529 bp, Homo sapiens
aggattggcagaatttggaattatatgtcttattaaatatgctttgaaagacagaagtaataagttctggttaatcttttatagtgtttgtcttgggagcaaatagtatgagagagaggtgtgagaatgggaataataatctaacatatcaaaattagagaaccccaaaccatcacattctttctctttgtgccattttagaattgagaataccgtccttcttactgtggttatatttttacttttgtatataaacttgtagcagaaaataagattcagtagcttaaaggggccaggcactgtggctcatgcccgtaatcccagtggtttagaaggctgaggggaaggatcacttgaggcctggagtttgaaatcaacctgggcaacatagcaagactctgttccttcaaaaaaaatttttaaaaattagctgagcatggaggtgcatgcctataatcctagcaatgattataccattacactccagcctggatgatagagtgacaccctgtctcaaaagaaaaaaaaa

SEQ ID NO: 51919 - DNA, 489 bp, Homo sapiens
tgtcagattaacaaatgctctaatgaacaaatattaacattggttcaattttttctgacatttccagaaaagcttgggcacttaaagaagatcataaaaagccttagtttctactacgtatgttgttgtgtgagggtttttttttttaaatgaagtatgttgtcttttgtaaattgaatagttaaaaaaatgaactgtcacagatactaaaacctggtattcaacatactatgtttgactcaagtgttcacagaatgtgatgcaaacaaatgttctctcaacttacatccaggatagctaaaatattactttaacacatgttgaaagtagagtgctctatttggctagatataattccaggctgtctaagttgagtaatttcctcagacattccaactttgatcaactgcagcaagaacttttagcatgtctgtaaagcagccagtgcatctgtaaatatgtcctgagatagggagaaaagagaatgcc

SEQ ID NO: 51920 - DNA, 2924 bp, Homo sapiens
aaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtt

SEQ ID NO: 51921 - DNA, 3203 bp, Homo sapiens
aaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtttaaaaagaacctcttcttaagtgtatggcttacattttgtcaacacggtattaatgtgctttatatttacagttttctcagctctaaattaatatatccagcttttggttttctccataggcactttaacctcagtgtttccgaaactccattcgtcatcctccctaacttctcccaccacccccaacaaaaatttcctttacctctaagagcctctattttggttaacagaatcaacattatggaatcacccaatcaataaaattaagacaaatccta

SEQ ID NO: 51922 - DNA, 1496 bp, Homo sapiens
  misc_feature (55)..(55): n is a, c, g, or t
ccctctgagatagatacgccatctcagagggctgctaatataactaactgtacangacacacattatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtt

SEQ ID NO: 51923 - DNA, 2413 bp, Homo sapiens
aaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaagaaagattatcaaaggtatccatatataaatcaacaaacaactattgttcccagtgtggagagag

SEQ ID NO: 51924 - DNA, 1364 bp, Homo sapiens
caggatctcagaggtcgtatgacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtt

SEQ ID NO: 51925 - DNA, 2786 bp, Homo sapiens
aaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactcttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtt

SEQ ID NO: 51926 - DNA, 707 bp, Homo sapiens
  misc_feature (622)..(622): n is a, c, g, or t
gaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaaacaaaaaaccaacacacaacaaaaaacttttttgggccgccctgggcccctggaaaaacttttttaaaccccttncttgtgggccgggggccccaatgttacgcgaccgtggcaaagcgtgtcccaagaaaaaccgggccagaaagggcggggttcccca

SEQ ID NO: 51927 - DNA, 819 bp, Homo sapiens
  misc_feature (642)..(642): n is a, c, g, or t
  misc_feature (664)..(664): n is a, c, g, or t
  misc_feature (681)..(681): n is a, c, g, or t
  misc_feature (703)..(703): n is a, c, g, or t
gaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggagtaaaaaaaaaaaaaacaaaaaaaaaatttttggggggcttgggccttgaaaaagtttttaaaacactttgtttggggcgcgggggccccattggngtacgggaaccgtgggtcaaanggggttccagagaaaanccgggcgcgagacaagggcggnggattcccccgaagtaaaaagagcccggggcaaaccgggggttcggaaccaaccccaaggggatccggaggccacgaggagcctacacgggggtcccaagggagccgaataaaaca

SEQ ID NO: 51928 - DNA, 607 bp, Homo sapiens
gaggagggacccgcagctcagctacagcacagatcagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgga

SEQ ID NO: 51929 - DNA, 810 bp, Homo sapiens
gaggagggacccgcagctcagctacagcacagatcagaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggatcaaaaagaagacaaagaagacaaaaagatgtgtgtgggcaggcatgagggccgtgaaaaaggtgtttgacaaacagtccgataggggcacggggcacccgacggatagggaaaagtggt

SEQ ID NO: 51930 - DNA, 826 bp, Homo sapiens
tgggcgactgcctgacttctcctttcatttcagcaccatgaagcttctcacgggcctggttttctgctccttggtcctgagtgtcagcagccgaagcttcttttcgttccttggcgaggcttttgatggtaaggcttcagaaggtttgcaggatttctgaagagaaacatcgccctggacctgataaactggggaaaatgatgctttcggaaggctgcttttgaaccacagagttgctagtgtctgcgttgctgaggcctgccaggaactagggtttgctgggttgcctgtctcgagtctttcagagctgctgggaatatcccctttccccgtagtgcagcttctcaggatgtgttaagtggatggatcacatttcagaagccgctgcaaggtgtatcaaaaacacatctcctgagccgtaagggacggggcatccagtaacaacgcacacggggtatttttgggcttccttaagatttgagccgctgccttaggttgtgctgcccaatgtgcctggggagctgctaaacagattagagagtcgaggattgttgtcagttactcagagaaagaacaatcatcctttccaggagcacctgagctgtttgttttgagtagaagatgcaaaataaggcctgcaattggtataaaatgtccctcagcataaatcgcataggagtatgactaaggctgttgactcttctgtcttctttctccttcctccttcgatttcctagttggataatgtacagggctctttagcctcgctctgtcaggggctcccttcctggtttgttctgtttccattcttccttctccagccttc

SEQ ID NO: 51931 - DNA, 251 bp, Homo sapiens
gaggagggacccgcagctcagctacagcacagatcagaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggcttta

SEQ ID NO: 51932 - DNA, 690 bp, Homo sapiens
gaggagggacccgcagctcagctacagcacagatcagaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgga

SEQ ID NO: 51933 - DNA, 686 bp, Homo sapiens
tgcgacctttacaaatgagtacagcgtagctagaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgga

SEQ ID NO: 51934 - DNA, 970 bp, Homo sapiens
tgcgacctttacaaatgagtacagcgtagctagaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggtaaggcttcagaaggtttgcaggatttctgaagagaaacatcgccctggacctgataaactggggaaaatgatgctttcggaaggctgcttttgaaccacagagttgctagtgtctgcgttgctgaggcctgccaggaactagggtttgctgggttgcctgtctcgagtctttcagagctgctgggaatatcccctttccccgtagtgcagcttctcaggatgtgttaagtggatggatcacatttcagaagccgctgcaaggtgtatcaaaaacacatctcctgagccgtaagggacggggcatccagtaacaacgcacacggggtatttttgggcttccttaagatttgagccgctgccttaggttgtgctgcccaatgtgcctggggagctgctaaacagattagagagtcgaggattgttgtcagttactcagagaaagaacaatcatcctttccaggagcacctgagctgtttgttttgagtagaagatgcaaaataaggcctgcaattggtataaaatgtccctcagcataaatcgcataggagtatgactaaggctgttgactcttctgtcttctttctccttcctccttcgatttcctagttggataatgtacagggctctttagcctcgctctgtcaggggctcccttcctggtttgttctgtttccattcttccttctccagccttc

SEQ ID NO: 51935 - DNA, 344 bp, Homo sapiens
catataataggcatctaataaatgcttaagaggtggaaatttgttgaaacagtgtgttcttcttttggtgctgactgcctgtttggtacaaaagggaaatcaatgcacacccacatgaagggtgagcctaggtaggcctatgtgtttggatgtgaggagacattcttagtagtcacagtgcagacacctgcatcaacccttccacaaattagacctccttttttccagacctttgtggttacattgttgctatttccagtcccttccttgcccaggcttctcatctcctgtgaattatttcctgttaccttctctgtccctcagttcttcattcctcagtgatc

SEQ ID NO: 51936 - DNA, 546 bp, Homo sapiens
gaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgga

SEQ ID NO: 51937 - DNA, 738 bp, Homo sapiens
gaggagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggacaaaaaaaaaaaaaaaaaaaaaaaaaaaaaaaaaaaaaacaatggtcggtacggactgaggccctcgagaaagctcgaagaacacatcggttgggcgaggggacccacaagatacagggacacagggccaaaagcggtcccaaaggagaaccggggccaagaacaggggcggggattcccaccaattaaaag

SEQ ID NO: 51938 - DNA, 819 bp, Homo sapiens
  misc_feature (642)..(642): n is a, c, g, or t
  misc_feature (664)..(664): n is a, c, g, or t
  misc_feature (681)..(681): n is a, c, g, or t
  misc_feature (703)..(703): n is a, c, g, or t
acctctaagtatatagatacctatatataccatagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagcggggagagggtacacaatgggtatctaataaatacttaagaggtcaaagagaagtaaaaaaaaaaaaaacaaaaaaaaaatttttggggggcttgggccttgaaaaagtttttaaaacactttgtttggggcgcgggggccccattggngtacgggaaccgtgggtcaaanggggttccagagaaaanccgggcgcgagacaagggcggnggattcccccgaagtaaaaagagcccggggcaaaccgggggttcggaaccaaccccaaggggatccggaggccacgaggagcctacacgggggtcccaagggagccgaataaaaca

SEQ ID NO: 51939 - DNA, 565 bp, Homo sapiens
acctctaagtatatagatacctatatataccatagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtgga

SEQ ID NO: 51940 - DNA, 1029 bp, Homo sapiens
acctctaagtatatagatacctatatataccatagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcaggtaactggagctcctgggacgttagggctgggtgagcagagcttgcctgccttggacagtcaggagggagacgagctccttgtggagaagttagaggctgtggtccctcctcttcttgccctctctctgcctctgtgctcagtgtgagggtctgagtggatggtaggagtgagtgattcctccccctccccctctgggtgctgttcatccagcctaggggtgcccagcctgtctgaatggggcagtgcccaggcagggtcagtgtttcactcctccttccttggcctttctgggctcctctctgagccctcccttggaacagggagaatgggagggtgagctgttgctcactggcctgatgattaatctccttcttgcctgcctggactacagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatagaataatgtcaaatacgctacttaaatatatagagaaccagatctctgtggggggggcgggacaacga

SEQ ID NO: 51941 - DNA, 640 bp, Homo sapiens
agttagctctgactaccttgcctatgaacttttctttgaaattatgcttttctatgagaatttgtatattttttgttgatgtttctagccttttagcctgatgataggacctttgagtgtctgtctaggatacattggtaggtaagggtagaccatgatcatttttggcagaaatgaagcctgtttccagaaggcacgttcctccatgattttcctgaacatttttggttgatgacttgggggtcagggaatccattcaggtgagaggttagttttttggtcttcaaattggaagagcaactttagcctttgatttgtattatcttctcacagcaactattatgttgactgcctgtacatgccttcaataccatgtaaacctagtttatcttttgtatatttgatttcttagatggttagagctgcctgtaatcccagcactttgggaggccgaggtgggcagacctcatgatctactaaataagagaaattttctcttattaataagaaaaacccatctctactaaaataagaaaaaatagctgggcatggtggtgcacgccagtagttccagctactcgggaggccaaggaaggggaatcgcttgaacccgagaggcggaggttgcagtgaactgaga

SEQ ID NO: 51942 - DNA, 429 bp, Homo sapiens
actctgggactaggcatacacacggacaatggacgagcttctgtgacaatagaactctcaccccagaccctctgcagcaaccactcccctggaagccaaaccacaatctcccccagtgatccattcagaatggtcaagacttactcagttactgccatcatcccaacattttgctccctcttccaacatgggaccaatcagagaaagccaaataggttccccaaagcaatcctgtaagacacctgcagtgagctgatcagcctccagcttcctcatgccaacaccctccaagcagagcattcctgaaccttgcccctttccccccactataaacctatctgcctctgagtctgctaaacacaagagatcgtggctgattcctttgtaccgcaagctctgaataaaaagtctgtttttctcatgtttggt

SEQ ID NO: 51943 - DNA, 323 bp, Homo sapiens
ataaccttcatacagaaaagtacaccaataattaccacaaaatacattcacttttgcactaccacccaaattaggaaatagaacattaccagtacccagaagcccccttccacaaacagtgtattttaagtatttactaagcagttatgagaaaagtgatatttttccatagttttttttaatcagctttattaagatatggttcatataccatacatttcacccatttgaagtacacaattcagtggttcttagtatatttgcagatatgtgcaaccatcaccacagtcaactttagagcattttcatcacctcaaaaaaga

SEQ ID NO: 51944 - DNA, 704 bp, Homo sapiens
ggttgtgatgcagggacagaaaattcagaatgccacatgcttgcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagatcgtgccactgaactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaa

SEQ ID NO: 51945 - DNA, 3432 bp, Homo sapiens
gaattccgacttgttttgtggtctaacatatggtctatgctgcagaatggtccatgtgctgatgagaagaatgtatattctgcagctgttggaagaaagggtctgtaaatgtctgttaggtccatttggtctataatgcagattaagtctgatgtttctttctagatgatctgcccaatactgaaagtgaggcattaaaatcccctgcctttttttgtattaggatctgcctctctctttagctctaatagtgtttgtttatacatgtgagtactttggtattgggtgcatatatatttaaaattgttacatccttttgctgaattgatccctttttcattatgtaatgatcttctttgtccctttttatgttttctgacttagtctattatgaataagtggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51946 - DNA, 3346 bp, Homo sapiens
aggtgtggggggcgtgggccgcgggatgctgccgcccgctccgcctcgagctccagctccggtttttccctccaccatcctctgcccctccccgcctctcctttaactcccccctcctgggctcgggactggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51947 - DNA, 2960 bp, Homo sapiens
aggtgtggggggcgtgggccgcgggatgctgccgcccgctccgcctcgagctccagctccggtttttccctccaccatcctctgcccctccccgcctctcctttaactcccccctcctgggctcgggactggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51948 - DNA, 2429 bp, Homo sapiens
atgctgcctctgccatctggcgtctccagtctgcctgtatgttggttctgtattgctctcatctcacagtctcttattcccacgctctggccagtccaaagcatacatggcccagttagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51949 - DNA, 1909 bp, Homo sapiens
aaaaaaaaaaaaaaaaaaaaaaaaaaaaaaaaaaaaaaaaaaaaaaaaaaaaaaaaaatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51950 - DNA, 946 bp, Homo sapiens
gttttgttgttcaaatttcccttttacagtaaaactactgaggtgacggcataccccgccaccatggcaatatcaacttcctgtccccagaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51951 - DNA, 3230 bp, Homo sapiens
aggtgtggggggcgtgggccgcgggatgctgccgcccgctccgcctcgagctccagctccggtttttccctccaccatcctctgcccctccccgcctctcctttaactcccccctcctgggctcgggactggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51952 - DNA, 2342 bp, Homo sapiens
aggtgtggggggcgtgggccgcgggatgctgccgcccgctccgcctcgagctccagctccggtttttccctccaccatcctctgcccctccccgcctctcctttaactcccccctcctgggctcgggactggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggaggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacattttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51953 - DNA, 1744 bp, Homo sapiens
aggtgtggggggcgtgggccgcgggatgctgccgcccgctccgcctcgagctccagctccggtttttccctccaccatcctctgcccctccccgcctctcctttaactcccccctcctgggctcgggactggtttccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgccgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggatatgccgtcacctcagtagttttactgtaaaagggaaatttgaacaacaaaaaccaaaaaaaataaaaataaaaaacttcaaaagttga

SEQ ID NO: 51954 - DNA, 4325 bp, Homo sapiens
tgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51955 - DNA, 836 bp, Homo sapiens
ggccgcgtggttaatcggccgaggcctgcatcgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagtacaaggtaaaggatgtgcatagaccctgggggtctccaggattcttggagccgctacactggggatcaccaggaggatgacagcactgtctatgtagggaagggaacatagataaataaccccaggggtcctttcaagaccaa

SEQ ID NO: 51956 - DNA, 2844 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51957 - DNA, 2949 bp, Homo sapiens
  misc_feature (32)..(32): n is a, c, g, or t
  misc_feature (70)..(70): n is a, c, g, or t
gcccaacactcgactacgggacctacaaatgntttgggtcaaaaacccacgcaagggcttaatttaaganaacgagcatatatacgtctaagtacagctggtgggatcgcacagagcgctggcagatagtcgggtgccccgacagcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51958 - DNA, 4099 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51959 - DNA, 4147 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctgctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51960 - DNA, 3633 bp, Homo sapiens
ctgcccttgttttcctccttgttccccaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51961 - DNA, 3453 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51962 - DNA, 3750 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaattcgtcctagagtcatgggtgccgagctctaat

SEQ ID NO: 51963 - DNA, 700 bp, Homo sapiens
taccttgccatgtcacatcgccagcattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 51964 - DNA, 2013 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagtacaaggtaaaggatgtgcatagaccctgggggtctccaggattcttggagccgctacactggggatcaccaggaggatgacagcactgtctatgtagggaagggaacatagataaataaccccaggggtcctttcaagaccaa

SEQ ID NO: 51965 - DNA, 1979 bp, Homo sapiens
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaagtgggtccccctgctcctgccccagctgcctgggcctctgcattctgtgaggcctgccccattgagcccatgcctacatctccagcatcatctcccttcctttccgtctgctgctgcattctggccaaacagcatctttcccagcagcctctttcccccgttggaccctcccgggggggtttccctctgcctgagacaccctccctgttccttgcacgcttgctgccccttctctcccttctggtctcggtccccatgccttcccctccggccgtctctcatttactgccccgttttgggccctcagagtaccttgttgtttccttcacacaggctaccaccattggtaattacatatttatccctggtaactttgtaataatgctaataatactatctaccatttattgagctttaattatgtagaaggaactcactactttgtatgaagtatcactttaaatcctcataactgcccctttgaggaatttatccccactgaatactcagacttgagagagtaaataacttgctccagtaatagtgtttaatctctgtacccaccaggagaggggctttgttttaatcactgctatatcccctgccctgagagcaacacctgacccacagtcaataatatagttgctgaatgaatttaatggatatgagaggaggtgatgggtgcatagttatccagaggggccaacctccagtgacccacacactgcagtattagacaagtgtcctcttgttgctgggccccagtgaccacatttatatactcaagtacctaaaagtaattatcagcacagatcctttgtcacagctttgacatcatatgaccccagacccttccaggtgccactctctggcctgatgccaggcagtggcaagcacacagagctgcagcacacatgcttctgctgtcaagaccctgcagtctaatacgggaaacagatatgctgcgttcatgaagaattatgacaccaggaaatgtgtgatcaggagcccagacaagctttattctttaagacctttttgatcctaagtgacagaaaa

SEQ ID NO: 51966 - DNA, 1699 bp, Homo sapiens
  misc_feature (1222)..(1222): n is a, c, g, or t
  misc_feature (1230)..(1230): n is a, c, g, or t
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggcatctgaaaattctcatctaccccctggaatcagccttggggtaccccaacngagtcatntgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgccaggaagcaaagtcaagcttgtttctgccaacgtggtgcatgagagcacatgctgcttccgccccggaacctgagcacgctgagacgccccagcccatcccccatctctgctgtcatcacctcaccacttcctaaactgccaccgcgtt

SEQ ID NO: 51967 - DNA, 373 bp, Homo sapiens
aaatattcatcacacattccccaggctcaggcaccatgcaaggcacagggtgcccagagggaacatgcagcacccactgctgcctccagctacccctgcatcttgcatcctcatgctgctctctttctctgtccccccacccccgcctgccctgcctccttcagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggaca

SEQ ID NO: 51968 - DNA, 2199 bp, Homo sapiens
  misc_feature (710)..(710): n is a, c, g, or t
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggacatctccagggatggagagctcatcccngcctcctgctttaccttccgcatcaccatcacttgttaattcagcaagtgaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctct

SEQ ID NO: 51969 - DNA, 310 bp, Homo sapiens
caccagggttccctgttaatatgtatacgttttccatgatctgatcatgatatcgtatgggcttggccagtgagagctggcgcagtcaactgcagggtgtcctcccagccagtgacagtgtggcttctgcaggtacctcgttccccagtcaggatatgcgtgctgtccagggtccagggacgccgtccctgccccgtccagggtcctggagctggcttgactcctcgccttacatcccccagtccaaatcctctcgtcttccaaggcccattccaaggttggccaagtttctcctcctccacagcggatc

SEQ ID NO: 51970 - DNA, 779 bp, Homo sapiens
  misc_feature (778)..(779): n is a, c, g, or t
tgcaggggagggatctttcagtctgtgccctatgaagagacaatttcatcttttttagcacacctgggcatctgagggacattcagcaccagctgtgtcattctcaaatagaaaagtagtaggacatttaataaaggcaacaattaatattgaagaagtggaatcttttggaaacactccctggagtgctccttgacagagaccgagagtaactactgtgcacagctggcacagatccaggctcagatcggggccctggaggagcagctgcaccaggtcagaaccgagaccgagggccagaagctcgagtatgagcagctccttgacatcaaggtccacctggaaaaagaaattgagacctactgcctcctgatagatggagaagatggctcctgttctaaatcaaaaggctatggaggcccaggaaatcaaacaaaagattcatctaaaaccaccattgtcaaaacagttgttgaagagatagatcctcgtggcaaagttctctcatccagagttcacactgtggaagagaaatccaccaaagtcaacaacaagaatgaacagagggtgtcttcctgaactccagcctctgagacagaatggcccccaaattaaaataccaaaatgaagctagtttcctaaataagggtccccttatttttctgcttttcttccaatgaattaagacaagttatttttagaatagtaccatttctttggctttttctctatggtggtgtttcaataaaagttcttcctgttgcaagtcaaaaaaaann

SEQ ID NO: 51971 - DNA, 482 bp, Homo sapiens
tcaaatgttaatctcttttggcaacaccccacacagacagtacccaggattaatactttgtatccctcaatccaatcaagttgacactcagtattaaccatcacacacttctagaagctttctttcatgatactcttcattttaagttactcatattcagcttgtgagaatgatgagaggcaaagaaagttttatgacctactcaaatcacacaggcaatagccaataaaacatatctcacccttacagctaaaaaagctttaaaatcccttcaaaaaacaattcatcttatctacttttcattagattgcaataaaatgattttcttaaattgagataaaggtacatgttctgcattctaactaatagtataggctgagctcttataactttgattgtctcctctgataaactcaagttctccacttgatgtaacagaccaccagaattatccttagtatttctatagaccacgtattgct

SEQ ID NO: 51972 - DNA, 805 bp, Homo sapiens
  misc_feature (29)..(29): n is a, c, g, or t
gtgtctcaaagaaaatgcatgagagcaangcaatggaaagtgtccagttggggaggggagctattttcactaggatgccaacaaaggcttccctgaagactgggcatttgagctgagacctaaatgtgaagatggctgggagctggtgtatggagcatagggttcgctagaggaaaggcagctgtaaagacccaagtcaggaatcagtgtcttgtgttggaaagccaggaggaagaccagagtggctgaagcattattagctgtagagagagagtagattatgaagtcaggagattggcagacctcaaggcgtgcagagcagggcagggagtgtggatgccgtggtgttttcagttctttcaatcaatattttactgcctgcagcccattttcttttacagcctgtcttcttttccttctgctttgactcgagtcttacctcataatgggcattttaatcctctctgtgatgcaatccaatgcttcttgctgggcaccttgctttattccagctcagggcagcattaaaaaagaacagaggaagtctccagccgagaggggctcaggaaggggtgcaggttgcaatctaagagctttaattaaatcaatgccgtgcacatcctgtccacaaagctgggggcaattgcatgctctttactgacgccatgatatacacttaagagctgtgtgacttcacagaagcaattaaattggcctgtttaatcagtggtaaggccaccatcaataacaattattatttttattgatttgataagtgcacagtagaaataatcacagagaatag

SEQ ID NO: 51973 - DNA, 700 bp, Homo sapiens
agctggagaattcaaaggattcaaaacattaacttgcctgaacgtatcctgtagcacaaagaaaaaaattaaggagtattttaaagatacttgaaaacttctaaatatattttcacatgtttttccacctgaaagaatctgtccaaggctgccctgagatgctttttggccgaattctaaggtagatcattaataaaagaagaagaaaagaaaatgccttagaaccatagtaagtaaggggctttcttgaacactggcgtactgctctttgagaacaaagggaaggggattttactgtgtcccattcaaactggtttgctttcttgtcgagtcacaaagggcctgggatttctgggagctcgtgagatgcgtctgtgcatacacactagcaaaagtgtgccgctcctttcaaagtaactgttccactcattcctgctatgacacagcaaggccttgtgtttcggatttcccaggatatagtacgccagtctacccttcccagtgggggaagatcacaggcctgcaaaacaggttctgaacaaacaataacacagtattactttcataaaacccgaagattactgaaattacaggaatcatcctttccgtttttctcctcctagtttcatgtagagtaggaaaattatgagttttttttttaacctttgtatgccaccaataaaaatcctacagaaaattc

SEQ ID NO: 51974 - DNA, 1192 bp, Homo sapiens
  misc_feature (534)..(534): n is a, c, g, or t
  misc_feature (632)..(632): n is a, c, g, or t
  misc_feature (721)..(721): n is a, c, g, or t
  misc_feature (723)..(723): n is a, c, g, or t
  misc_feature (781)..(781): n is a, c, g, or t
  misc_feature (794)..(794): n is a, c, g, or t
cataaaatcataatccacaaactgttattctctccacttctccccctccctaaataaacccttctagtgtttcatgtgactctcatctgtgttcagcagtccagtcccctttccctcattttcccatcatctccttgccttaccttagttgaaacctatctggtccctgagagaatgtcagggccaggattggaggtaggtgcattccttgctctctcccattgctactttcaaattatttcaccccttccctcctgcaaaaatcaccgttcttttgatgtttatgtcatctggatataccaccctttcttagaccttctcactatcttctgccaacatcctagtcaaatctcttcatttactgaagtcttccattcctggcaaaaggtcttccattctaacccagttccttcctttatccttggtgatttccatacctgactggatgatgcaaaaactctcagcttctcagtttctttacttccatattccaatgacattcacaaatttagggactaaatgctacctgggttnccagggcacacctagacaaacaagggagaagagtgtcagatcagaatcatggagaaatgggcggggtggtgtgggtgatgggactcattgtagaaggnagccttgctcattcttgaggagcattaaggtattcgaaactgccaaggtgctggtgcggatggacactaatgcagccacgattggagananctttgcttcatagtattggagcacatgttactgcttcattttgggagcttgtggagtngatgactttctgntttctggtttgtaaattatttgctaagcatattttctctaggcttttttccttttggggttctaacagtcgtaaaagagataataagattagttggacagtttaaagcttttattcgtcctttgacaaaagtaaatgggagggcattccatccctttcctgaaggggggacactccatgagtgtctgtgagaggcagctatctgcactctaaactgcaaacagaaatcaggtgttttaaagactgaatgttttatttatcaaaatgtagcttttggggagggaggggaaatgtaatactggaataatttgtaaatgattttaattttatattcagtgaaaagattttatttatggaattaaccatttaataaagaaatatttacctaaaaaaaaaacc

SEQ ID NO: 51975 - DNA, 196 bp, Homo sapiens
aaaataagaggccgaaagctacctaacaagaatattaaaacttaaaaataaaagactaaaggaaaacctattcattaggtaaaaaataagaaataacagataccaaaaacaagaatggcaagatgaaagtataaactaaaaatatttttggaagtttgaagaaaaggacgactggttgcagtggatgatgcctgta

SEQ ID NO: 51976 - DNA, 1150 bp, Homo sapiens
  misc_feature (1149)..(1149): n is a, c, g, or t
cggattccgggcgcagccgcggctgagcccggggcgttgaatgcgggtggaatttccagtctgggaaggggcggggccttggaccgccgggaagtttggtcctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaaggtggagtctcgctctgttacccaggctggagtgtagtggtacaatcttggctcactacagcctccgcctcctgggttcaagcgattctcctgcctcagcctccagagtagctgggactacaggcatgcgccacgacgcccagctaatttttgtatttttagcagagacagggttttgccatgttggccaggctggtctcgaacttctgacctcaagtgatccacctgccctggcctcccaaagtgctgggattacaagtgtgagccaccgtacctggcctgctattacctcttaattagaatttgagttgtattcagtcttttgtcactaaataaatgcttctataaacattnc

SEQ ID NO: 51977 - DNA, 753 bp, Homo sapiens
cggattccgggcgcagccgcggctgagcccggggcgttgaatgcgggtggaatttccagtctgggaaggggcggggccttggaccgccgggaagtttggtcctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtgtcttactccgtaacccaggctggagtgcagtgacacaatcatggcttactgcaaacttcacctgccaggctcaagtcatctgcccatctcagcctccccagtaactgggactataggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtttgtatatttgtcaggcagatt

SEQ ID NO: 51978 - DNA, 446 bp, Homo sapiens
gtcactggcaaaacataattaattcttcatctaattttagtgctcacatggagtggccaagaagaagtagtgagtcatacctctcaagtgcagctgtccaacaggtaacactgactggaaatttgcatttatccaacgaaaaatcatttacttcatagctaacagctatttatacagtatgtacttaaccaggcttctggaaacaaaactaatatggacaaacccaaaagtataaaggagcagtgttttatattctttgatttcttatctgaaggtagatctaagagtgctttgcaagctttttcagataacacagttgacatttaaatggtaaaacatgttatttgtagacagtgatttactgcttctctacctaaacattgagcagagatcgcgccactgcactccagcctgggcgacagagcaagactccgtctcaaaaaaaa

SEQ ID NO: 51979 - DNA, 3111 bp, Homo sapiens
caagtgaatgagccgtgccaaaaagacggttggatcctgcatagtggtgagaggggtgatccattctgcctcatcatttaagctgtctggagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatttttaaaatatatgcattaaaagtttactttaatttccagtgggacttcctttatgaaattttccataacctcttcctggagtattacaagatctccaacatctcataaactaattgtgatattagtggaaccataagcaaatgtatatttttagtggaaatagattatgaatgaaagccaagcaccttactttaaagccaaaatatgagattttcattaaaaacattggtcataatagggagaggttttttatttgttctgagcaaatcctttaacctctcctgatgatacagttcagagtacacacactttggtgatggatcaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtcttggctattaaggggcacttatccatacaacctctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 51980 - DNA, 3369 bp, Homo sapiens
cggattccgggcgcagccgcggctgagcccggggcgttgaatgcgggtggaatttccagtctgggaaggggcggggccttggaccgccgggaagtttggtcctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatttttaaaatatatgcattaaaagtttactttaatttccagtgggacttcctttatgaaattttccataacctcttcctggagtattacaagatctccaacatctcataaactaattgtgatattagtggaaccataagcaaatgtatatttttagtggaaatagattatgaatgaaagccaagcaccttactttaaagccaaaatatgagattttcattaaaaacattggtcataatagggagaggttttttatttgttctgagcaaatcctttaacctctcctgatgatacagttcagagtacacacactttggtgatggatcaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtcttggctattaaggggcacttatccatacaacctctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 51981 - DNA, 1383 bp, Homo sapiens
aagcagtggtatcaagcgcagagtgcccattacggccgggagttaaaggttatgaaaatgaatgatacaggcatcaacaaagaaattttctttggagaagttatataaagagcccagcatttctagtatacaaatggtggactgtgtaagagacttctagaacaatcactgccttacctacatgggatgcacctctgcatttcacatttttactctgttatgcaagatggagacctttgtattccttggaattggaagaatggagaagccattaagtaacacagaaatctgtttatttttttaagagataagaaaggaacttaaattaaaaatatttaaatccacaatttggatataacagtattatttacataagaacaaagtttctaactgctgctttaaaagtagacttttttaaaaaaattaatttctgctagggagaggttttttatttgttctgagcaaatcctttaacctctcctgatgatacagttcagagtacacacactttggtgatggatcaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtcttggctattaaggggcacttatccatacaacctctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 51982 - DNA, 1062 bp, Homo sapiens
ctggatgatgaatacccttgatacccccctgggggccccaaaaatgaaggcaggtgtcggttcatctggggtaagacccaagggttcattgcctcatgcccaaggaaatgaagacagtgtccgttcatctggggttatacccaagggttcactgcgtcatgccaaggaagtcaaggacacgaacacatgtgaagtgaggttaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtcttggctattaaggggcacttatccatacaacctctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 51983 - DNA, 567 bp, Homo sapiens
tccgtctcaaaaaaaaaaagttaactgcaattgttcttttgcttacagctttattcttactccatgcttatttttctcttttcagtacaagttcagggacctaactgtggaagaactaaggaatgtaaatgtatttttcccacatttcaaatattccatggacacctatggtaagaatcatatcctctagtttaaatgctgcattatttgaactactaatttttggtcctaaagagctgcaaaattgtaatttctctttttctcttttatcctctgattttcagctatactttatgacctgcaatttctgagaaagcttaaattaatacaatgtatcttgtattagttttctattgctgctgtaacaaactaccacaaacttagtggctttaaaaaacacacgtttactgtgttataattctgtaggcaagaagtccaccacaaatttctatagcttagaaagtaaactagaggtttgacttggctaaaatccaggtgtcaactgcctttgtttctggaggctctgggagataatgtttccttgcctttttcagtttctagaggtca

SEQ ID NO: 51984 - DNA, 413 bp, Homo sapiens
ggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgcagtgactcacgcctgtaatcccagcaccttgggaggctgaggcgggcagatcacgaggtcaggagattgagatcatcctggctaacatggtgaaaccctgtctctactaaaaatacaaaaagttagccaggcgtggtggcaggtgcctgtagtcccagctactcggaaggctgaggcaagagaatggcgtgaacccggtaggtggagcttgcagtgagcagagatcgcgccactgcactccagcctgggcgacagagcaagactccgtctca

SEQ ID NO: 51985 - DNA, 935 bp, Homo sapiens
gtgctgaggatgaagcattaatctcaatgtgaataaagctagaagtgaacagtgctgtgtagtccttgaggctctgagtggatctggttcctcctgtggtctctgctgagaatgcagcttcctgtgggagatgtcgatcttgtaactgaatgatagagacaatcagataaaaatgatccatgttgtatttgttggatgtgatcttgttctccagtgtgtacttttggtaaaagacatggtaataataggtctgcaggtgacactattcacctgctcttcctaagggatgctgggtcttgaggaaccggcagtagagacactgaactgcttatagactcacatctggtatcatcaggttggacctgggatactgtctggctaactaacacttcctggcccccatgactgcagagttccaggttctacatcagtacccggttctctgaaatatgtactcattggggtctcatgaatatggaattgaaatccattttactgttgtactcacttagagggaacatagcctttgtttccttacttaaccatgtgagccacagagtaagaagaaaaccgtctctttaaaagctgctatttaggtagctgccttcatggcagataaatcttttccacaggtttggaaaatatcaaagatgcatctgtttcataattacatggtggctttctacctaatgaatgcctgtgtaggctgctacgttaagcatacaaagaggataggagaagaaagttacttcgtatttatttttcaggcttttcctgtctgtgttctcacttcgttattgtggggtttctgcagactgagtccctgtggaagagaggttgtgtcctgctcattgtggtacagcagtggcttaagggagaactggagccctgacttcacccccaccccactccctttatttgacctgggattaaaa

SEQ ID NO: 51986 - DNA, 458 bp, Homo sapiens
gatggtcgtaccctgtctgactacaacatccagaaagagtctaccctgcacctagcccaacgtgaaaacagacacatcttgccatgatctctgactggaggaagcgaggaggcggccggccgcactgggagcagcgcgggatttctctttctctctcactctctttcctttcattctagtattcttaattatttatttttctctctctctcgttcgctcgctctctcgtactctctctcttttcctcctttcctttttctttccctttcccctttttctttcccttctttttccctttcctttcctttcattttctttcctttccccttcccttcccttcccttccatctcttcctttcctttccctttcttttcttttgctttcctttcctttttttcccttttctttccttttcataagaggttctaacttctgttgacaaaggaaacacatactc

SEQ ID NO: 51987 - DNA, 1482 bp, Homo sapiens
acattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaggccttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcgggatttctctttctctctcactctctttcctttcattctagtattcttaattatttatttttctctctctctcgttcgctcgctctctcgtactctctctcttttcctcctttcctttttctttccctttcccctttttctttcccttctttttccctttcctttcctttcattttctttcctttccccttcccttcccttcccttccatctcttcctttcctttccctttcttttcttttgctttcctttcctttttttcccttttctttccttttcataagaggttctaacttctgttgacaaaggaaacacatactc

SEQ ID NO: 51988 - DNA, 420 bp, Homo sapiens
aaacgtttggcaactcctggtggatatgattgcctctgacaagagagtgtgagttcctggaggatgcagattacgtggtttatttatcgataaatgggtttttaataatgcaataaattacataaataaatgcgataaatcacatgaatgattaatttttgatagatgtcacctataagtaaaaaaaaaatgaatgagccattgaataaatgaatgtcagaaggcctgagttcagtcctttgtaacttcagagaaattgtggaggctgtattttttcctctgataaaaggagaaggttatctagagctctgttatcattgtgaacattgcaaatgtggctattcctggaaaagagagaatgaagagtgtggtaagcaaagagactgcttcccaacttaaaaagggcaaagaatttgtgag

SEQ ID NO: 51989 - DNA, 267 bp, Homo sapiens
attactgcaggtgctgatagaaagcagagcttaattgtacaaataataacttttttttgttttgacattcacatcacaaagaattctaacaatttcaagttataagtgcttgaaaattatatgttccttttttagtatcaaacttactctttttttctcatttggtgcacatttgtgtgcacattcttgacttgtgctttttaaaatttagtttaaaccttccttggtggtttgttgcttatttttcctggataactgcctccttgt

SEQ ID NO: 51990 - DNA, 588 bp, Homo sapiens
ctcagctggcagccccagggaaatggcctcagttgcagagagccacctcagctgggtaataaacacctggccctctttgattcagggcacttctgaagggtcatataatcttcagaccttctgtaaggttggctgaagcttcctctcagacttcatcacagctcaatgtcatccttctctgaccagttccaccttgccttccctcatgttgatgtcaagagcgttccctagcaaactccccaaatgccaatctccagcttagattctgctttctggggaaactgaactgtgacagttactaatacaaagaatcaatatttttatgtcacattatacttagatagcttgaaatatatatgcatctagttacttaatacattattaaaaaactttttactatatcgaaaattactttttaaacattttagtaactgtatttcaagataattttctgtgttatcctatgccttttattttatgcatcttaaaacatcattctgagaaggagcctataggctttatcactgccaaaggagtccatggcaaaaaaaaaaaaaaaaaaaaaagttggaggagtcaagaacccct

SEQ ID NO: 51991 - DNA, 619 bp, Homo sapiens
ctcagctggcagccccagggaaatggcctcagttgcagagagccacctcagctgggtaataaacacctggccctctttgattcagggcacttctgaagggtcatataatcttcagaccttctgtaaggttggctgaagcttcctctcagacttcatcacagctcaatgtcatccttctctgaccagttccaccttgccttccctcatgttgatgtcaagagcgttccctagcaaactccccaaatgccaatctccagcttagattctgctttctggggaaactgaactgtgacagttactaatacaaagaatcaatatttttatgtcacattatacttagatagcttgaaatatatatgctcatccccacctcaatatttcagccttctgcatctagttacttaatacattattaaaaaactttttactatatcgaaaattactttttaaacattttagtaactgtatttcaagataattttctgtgttatcctatgccttttattttatgcatcttaaaacatcattctgagaaggagcctataggctttatcactgccaaaggagtccatggcaaaaaaaaaaaaaaaaaaaaaagttggaggagtcaagaacccct

SEQ ID NO: 51992 - DNA, 975 bp, Homo sapiens
gtagaatcccaaaatgaatactagaataacaatgttctttctcaaagtactacgtgttatgaatgaaaaaaaaaatgattagaacatagttcagattttgccagccagacaaaggcatttgtgctgtaatctgaggtatgccttcctgcactaagaggaacagggtttatgggaaaactaggattaggagcagaccatttgaaatctgtgcatctttgtaatttaagcactaatgtaaacctaataaaaagatagtagtgtgcttaaagataagttaaaatttttaaacaaataatttggtaaatttagaactttccctttaaaaacagtaaaggtgaccagaagtggtggcactactcagggctagctgtatttaactgttgttacctgcaaatgcaaaaactaaataacattttaggaaaaattggaaatgaaccaatgtgatttctgaatgtactgacataattcccttatttactgattgcatatgagctaatgtatgtgttgtagtagaatagttccagtagttctttaccttttctgtgcttatcatgcctccttcctttctactgttaatgttcaagttttaatcttccagacttctcatttgttctgtaacagtatcttctagccacgtgtgcccttctaatctctcttgtggaatttgttcttcacaatactacaagaattctattgcattgaaaaccccaaatcttattaagccagcctccatcattagagcatgtttctcaaactcttggtgtgtgcaaatcattcttattctgtgatttctattttcatgctttttcagtttgcttcatttgccatatgatagaggttttcttcagaccatattttggaaagtatgctcttagttttaaattctactatgggttatttccaagacccatagtagaatttaacaaattctttcaaataaaaaattttaaagccttcgcttattatcaactagcc

SEQ ID NO: 51993 - DNA, 319 bp, Homo sapiens
cgaatgtggaatgtggaggttacacagcgatgcctagactgtctgtccttagaccgaagggcagcagaaaggctcagggggcttgctctatattccttagacatctccggagattttctcagcatcagaatcagatcctcccatggcctgcggctacttttaagaaagtttggcaaccttttggatatgtcctcttctcttttttgactttccaggctgtaaaccttcagaagcttccacatgtggtgccagtgggctcctggtggtgaaggaaggtggcagtgtggtttagtggaaaagaatatctgctctggagttg

SEQ ID NO: 51994 - DNA, 306 bp, Homo sapiens
gaggtttagtagatttcattagagtcttcatctgttatcggaggggaagttggttttcccacttatgcttgggcatgacacataatgtgtaaataaccatgatagaggatcatgggcagagagcattggatgaacattaataggattcatcaaatcaaggagggtcagaggccccattttacaaggtgtgataggaaagcagtgtggggtcttgtttttcagtttttgaggtgaaggaaggttgtaaccatggccttctaagtctgaaagtgtattcattggcctgggcttcgtgagacttttttt

SEQ ID NO: 51995 - DNA, 350 bp, Homo sapiens
tgataaaagagagggcttgaatcagcagtggaagttgtccactccaacaagaaatggcacatgcctcgaggcagaggatgaacagatggcatgtaacttggactatcagcctgttgaggcagctgccctcacgcaggtcctcagatcctcatacagggaaaaggggatttgcattatggctccaggaagtaagagaaatgggattgctctcctaggtagaattttgatacataaacaagaaaataaggagaatgtttttctgttattgctctctcttgtgcttactcatttttcagaagcagtcagtttatgtggaaagatttgacaattcaataaattcagcaaacttt

SEQ ID NO: 51996 - DNA, 872 bp, Homo sapiens
  misc_feature (14)..(14): n is a, c, g, or t
  misc_feature (26)..(26): n is a, c, g, or t
cttgaacacttttnctgatgaacttnacttctgccttcaaagcgattttaacgagaggaggtgcggaagacctacttaaaacctgagagtctcgaataggagaggcgctttcagatcagcccgagtcttctgcagcgcacaggagctagtcgtactgaaaagaatgaagttggacttgtccaggcgagtttcggacagtgctgggctgccctgctctgatctcctgggtgtcttcacctcctctggttcctaagtcggctgctgcaccagcacccatcaaactctcctggaagaggaagtgacagctcaccggtagcctagaaggcccctgtgggcagaagcatggacttactcctcctcatggagatgcggctgagccatatttccttggcacctctctggaaccttcgacaaccaccacctcagacactaaccagactttaggtccattcctttcatggctaaaatgagacagtccacaatgttgattttatttgtaggggatgtcaggattccagaaaagcagacttggaaagcaacaaaacgttaacttgcagctcactgaggcccttacacttgttctgggcacctctgtatgttaaaagaagtccaatatctttagctgctggttataggtggccatatgtttctgcacagaaatggggctccccttgctagactaattttctaatttttcctcaagcttcattgattcatattcttctacttgaccctgactgtcaggaccaacaacaccaaataacaccaaagtctcttgctcctgtcctcagaacctctcagaggcatcctctgccctgttggagccattttatttcaggttgatccttaattaaattcagcgagatgcagga

SEQ ID NO: 51997 - DNA, 316 bp, Homo sapiens
cccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatgg

SEQ ID NO: 51998 - DNA, 655 bp, Homo sapiens
  misc_feature (482)..(482): n is a, c, g, or t
ttcagggatagttgctgttctcttctgtggagtcacacaagcacattatacctacaacaatctgtcttcggattccaaaataagaactaaacagttgtttgaatttatgaactttttgggcggagaacgtcatcttctgttacatgggcctggcactgttcacgttccagaatcatatctttaatgctctttttatacttggagcctttctagcaattttggttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagagttggngtggacctggatgaacatctgaaggaggacccctcctcacaaaaccaggaagcacataacttggctcaaaacatgacgaaagccgagagtgctcggatcctcagaatgtggtatagctttgaccacaagtatctgaaaccaatttaacccattcggtcctcgatgactacact

SEQ ID NO: 51999 - DNA, 754 bp, Homo sapiens
ttcagggatagttgctgttctcttctgtggagtcacacaagcacattatacctacaacaatctgtcttcggattccaaaataagaactaaacagttgtttgaatttatgaactttttgggcggagaacgtcatcttctgttacatgggcctggcactgttcacgttccagaatcatatctttaatgctctttttatacttggagcctttctagcaattttggttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagactcttctccaaaaacaccacgaagtaagtaaattggagctttaataaaatcacacaaatggagaaacccaagagacacgaagacaaacgtgatattgaatgaacccaaacaccctcaattggaatgtgatttgtttatctactttacgtggccttcccttcttgagtctatatttttttctctgaaattatttgatatgtacttgaattagtttttttaatccccataaaatttgccatccagctgcaaactaccacagtaggatgcaaagaaaatgt

SEQ ID NO: 52000 - DNA, 479 bp, Homo sapiens
aagacaattttctcctggaagggagattttaataagctgtaagattcaggtggtgactcaagagaccgtggtttagcccccacctgccagtcccctcccagccgtccagccctgctgcctcttcccgggccttcttcccctgccacctccacctgcctgcagatctcagcatctgctggccgccctgggctcaggaagtcagcctgttggagtgactcgccagtagtcggacccgagagtgggagagatgggacctggggaggcctctggggctgttgcatccagaaactgctgctctctcatcttccctctcaggccagtgagtgaggtgtgcacacctctcagtcgtccacatggccacgagtgttttcagggctcctaagcgctggcaaagaccgcagctgcccctctggatccatcacattccagcaatgttcctgcctggcctccgatggccctgtctgggaatccaggtgcac

SEQ ID NO: 52001 - DNA, 485 bp, Homo sapiens
gaactagtgagtagtagaggtggaatttgagtctggatgtggctgattccagaatccaagcatttgggccctctacttgttagtcttcaatgatgttgcttatgccatatcctatttcttggtattggtttgtgcatttgttaaagaagattagcatagaataatgggtctcactgtgtgactttgttcccccacaacatgtgacaatgtctacagacatttttggttgtcacaacatgggaggaggtgtgtgcatgctgctggcatctagagggtagaggcagggatgctactagatattccataacacacaagtcagtctcctgacaaagaagtattcagcctcaaatgtcagtagtgctaagtgccaccagtagacaccccagtgtagaccatctgaaacctcttccaaccttgaaagttcatggcactcttccagagctcccccgtcagtgacatcagtgttaagtgcaggaaggtgtctc

SEQ ID NO: 52002 - DNA, 296 bp, Homo sapiens
gtttcaccatgttggccaggctggtctcgaactcctgaccttgggtgatccacctgcctctgcctcccaaagcgctgggattacaggcaaatatcacttttatttttgattgggctgacacttgaaaggttaagggactcacccagatcacacaggagagctgtgaacccaggtctgggtgacccgctcctaaccatggaccatggcccatcctgcagcatccccggctcatgctacccttcagggcagtgagtgcagagaggctgaggagaggcctggaaggttgagtgacatgt

SEQ ID NO: 52003 - DNA, 416 bp, Homo sapiens
ctgggctggctcatgcattctgtgggcaggtgctgagtcagatgggtacaggataggctagggcagcccctgctgggatgtcattgtggtttcttgttcttcatcaggctagcctgggcttcttcacattgtaggttgcagcaaaaggaagcgtgcaaatcctgttgatgtctaggctgaaactgaaacaatgtcactcctgatccattctatttgtcccagaaaatcacaaggttagcccagattcaaatatactctatctctggatgaaaggagccacaaggctgcattgcagatgaacttatacacagtgaagtgaataatggcaaccatttttgcaaatatttggctacactttctatgtctgtgagtttgatgtgtcaacttgggtaggctgttgcacccagctatttaat

SEQ ID NO: 52004 - DNA, 306 bp, Homo sapiens
aggcagtgttgaaagtaaggaagattggaacctgtctcagtaagaagctgagaggcttagagaaagttcctcaacacagcaaaacccaacattttaaaaacagaagcagaaacagttttataaaggcattgccacccccaccattgcacacaggctttgtttgttgttgtcagtaacattataagcactccatctttgggccttagttaatgctactactccaggttcctgcgttacccaagaaagttcctcccaaattgggagctgtaaccatctgttgatactcaaggctctccgaacagctat

SEQ ID NO: 52005 - DNA, 481 bp, Homo sapiens
gagcctgtgtcctggtctgaaattgagttccttcctcagggacctgaactcagtcagggatgtggtcattgagggacccctatcaggggcagtggttgtggaaggaggaaccctccttgagctgaggactccgctgtcccacatggtagtgtttctctccagaatgtcgggggagaggagcccaaattctagtccagaattctgtgaaattgagcagatgagaactcccaccattgaggtagatcctatccagaccatgcaccttccacccaagggacaatgaaatgcatgggtcccacgggtcagcaaacatctgttgggtgcctgcctgcaggggaatggatctggctcagggcatcagagacagcggggaccaagtggacccagacctgctctcatggggtcacagaaaataaggaaacataacaaggacaaggcatggtggttcacacctgcaatcccagccctttgggaggcagag

SEQ ID NO: 52006 - DNA, 337 bp, Homo sapiens
cagcacctggcctataaggtatctttaaacagaaacacacataaacaaaggttatgcattgatctgccaggcagaaggtggggttagaaaaagatgtttctggcagaaaggtcagcatgtacagagatagccaagagcttggcaaggccaggggactcaaggagagccagtgggcagggagtgtggtggtgaaagggagagaggctggggccaggcggctcagtgtcttgtgggcagctctcatttcatccgattagcacggtaatcctggcaggttggacaggatcatttccgcctttgagagatgatgaaattgacgttccatgctgttaaatga

SEQ ID NO: 52007 - DNA, 2004 bp, Homo sapiens
aaaaaaaaaaagtttcaggtgtattcaggagtggtcatattaagcttgtcacctgatcctggttatgaggttaacagcaaaatgaaataaaatatttttctgagccatttgtttctcctctcatggaagacactaattctgtttatttctatattcggccttgtgttgaaacagactgtaaaatcatgttttaaaaaagcttcacccatccttgtggagggtggtggtttgcaaaagcaccaccccacttaagcatttatattgagaagatatttatggcattcttccattcatgaaaatgggtatgctttgttctggagttcttaccttgatttatctactaacactaaagttcctcacttccaatttcttatacctctaacccaacagcttataaactgcatgtagtatagtatttgcttgaaatatgtgaaagtagttattttccctaactaatagggatatttctgtggtggttgtagttactttgcaacctgttcagcaaatattatagggcgtttttgatggtatctttaaattttggacatagagaaccatcttggataacctctttccccccagtctcagtcatccctttggaggtagtgtctcatttttaatctgtgacttgtggaagttaaggcatttgagtagcttatttaaagtattaataatctgatttctggagatctgaggaatagcagacacccttttctgtattaaattggggaaatttattttataggcaaaaagatgaataaaatggtcctagtagacagcccctaatatttctggtctcgggtaaaggtcttaaggaagagggaaggtagtatcagaattttccaggtgtttttttttgttgtttgtttgtttgtttgttttgggtggacaggaagtagaatttattggtgagtattaagagggggcagcacagtggaagccctcatgagtgcagggcccgccacttgtccacagggccacgattggaaatgtacttgacccgacagccatctgggatgagccgcttctcagtcaccatgtcttcaaactcattggcattgaacttggtgaagccccacttctttgagatgtggatcttctggcggccagaaaacttgaacttggccctgcgcagggcctcaatcacatgctccttgttctgcagcttggtgtgaatggagatgataacttggccagtgtgaaccctggccacagtgccctggggcttcccaaaggcacctcgcatgcctgtttggaacctacactggggtagtgcaaggtcagaaacatgaacatccatctgaaaggactgtctccagggtcccttagagcaacccatacaatacaacacacaggctgcatacactaccaaggaagctgctgtttgcagccattgcacactgggcccccccatgaggaaaggaactcagttggcttaataggctgcagcagggtgttttttaaaacacacaaatatacccaatccctactagaatgagagattttactaataatagtgttaggagtataaatggtttggtagccaaccactactttaaaattgattaggtctcccgggcttctgggccttcacatttaaatttgacctgaccttgaaacttcacctctcgttattcccagcgtgacttttgttttacccacttttcgaaataccccatgtgtagctccttacttcacgtcatgctggaatgtgacccataccagccaaactacatctaacagaaacataatacctaactaaaagcgtcttttatcatatagatagatgtacagggtatgttaatttatctttagagagactccccagtatactgaaaaaacagacctaagttttggtagatagccttgctttatagaaaatgaaaatgggccagacagtggtgactcattcctgaaatcccaacactttgggaggccaaggcaggaggatcacttttgaggccaggagtttgagaccagcctgggcaacatagcaagaccctg

SEQ ID NO: 52008 - DNA, 928 bp, Homo sapiens
atctagagatagtaaatggtagaagttcaatgaagctatatgaccctgagttagttcaaaaccttgttctgccactagctatataaccctgggtaggttaacttactactctaatctcagtttgcaacctgcgaataggcctgatagtgaatagtatcagcctcataggcagttttgagcattaagtacgttcatatctgtgaattgcttggctctttctgtgtcttgcccataagttcttagaaaacatgaaagcatattgcttttattcccaagttactaaggtgtatgtcagaaacatttttcctatatatgattattttcaactttttaggttttaggcagatttagttataaatactgttttaaggtcaagtttcctgggaaacaggctacgaggcagagatttgcagttgaagtttattatggagtgtaatttggatcaacagtagtagcagagagtgaaagaatcaggaaccagcagaaggagagcctgagctgtcacaatatctcacaatcccttgatctgatgggttggaatggctcttaaggttgtcccagtttagacagaggggatcaggtctttttacacccctcacattgatgagtccttgaatgcaagatgcagctctggatgggaaggggaataatcttgggccaggtggctcttttgggctgagggtgctgcccagatggtgactcatctggcagctgacattcaccaaaacgatcaagagctggaagagtgagtgtccagtcccaaacagggcacctagtgatgcaccagtgtaccatcacatgtgcatatataatattatttgcattcattatgaatgtctcgatttgttttgtaatagatctcccaggctcagattgagaaaaacataaaacaatttttattacaataccaaaattaactggctaatta

SEQ ID NO: 52009 - DNA, 465 bp, Homo sapiens
cagctaggctgcccttagtccccagcaagagggtcccttcccaaccccacgttagagggctctgcatattccaaacacacacaaataactgaactgaagaattcatggttgcctctgtgtcttgagttcctgcatcaggtctgcacagcatgggctgtgaccctaaacttctgctcttctggttaacacagaatgggccccaggaaagtgctctgacatacctcttggcctgtatcctcaaaacaaaagacaactgcatctgagtgccattaagtgttttgggttgtgttgctgctgatgttgggggtggattctgctttgatgtgctgagaggatctgaaggtagaagcacttagacacaaaagaggacaaaatggattaacttgttcaatcttttctcccagacagcatgtgtttcagtagatttttgaataagggaagtataatttcccagaagggcataag

SEQ ID NO: 52010 - DNA, 472 bp, Homo sapiens
ctcccaaaaaaactgtcatgtttcatttattagatgtttattttttcaacttcgctttttagtagtcatttagttaggttcattctaaagtgtgaagtaatgagatttaatacagagaagtctctgaaaatgtttggtccattgtatattagtcttgaataaatggaattctttttcacacttacccttgaaaatgtcatctgtagaaagctgggggagaggaatacctattctttaatgatggggaaataataccaaaatttatatttttattgactaaagtgttttttggggaagatttgttattggctaaccttaatgtctcattagttttaaatagttaaaaaaagtgggctgggtgcggtggctcacgcttgtaatatagcactttgggaggctgaggtgggcagattgaacccaggagttccagaccagcctgggcaacatgatgagatcctgtctctacaaaaaa

SEQ ID NO: 52011 - DNA, 1452 bp, Homo sapiens
atagtggcaggtgcctgtagtctcagctacttgggagactgaggcaggagaatcacttgaacctgggaggcagaggtttcggtgagccgagatggcgccactgcactccagcctgggcgacagactgagacacggtctcaaaaaaaaaaaaaaaaaaaaaaagaggaagaagattcttcccttaccctgcaatagtagaccagaaaaattaggaatatcttgaatttgaaagggacctaatgcctggcacagtggctcacgcatgtaatctcagaactctgggaggcagaggtgggcggatcgcctgaactcaggatttgagaccagcctggccaacatggtgaaaccctgtctctaaaaaaaaaaaaaaaattagccaggcgtgatggcatgcacttgtggtcccagctactcaggaagctgaggtcagaggatcacctgaacctgggaagcagaggttgcagtgaactgagatcacgccactgtactggctgacaaagtgagacccctgtctaaaaaaaagataaagagagttacctgaatctggaatccttaatcttgggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccatagaatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccacca

SEQ ID NO: 52012 - DNA, 3377 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttacttgtggtcccagctactcaggaagctgaggtcagaggatcacctgaacctgggaagcagaggttgcagtgaactgagatcacgccactgtactggctgacaaagtgagacccctgtctaaaaaaaagataaagagagttacctgaatctggaatccttaatcttgggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccatagaatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccacca

SEQ ID NO: 52013 - DNA, 3344 bp, Homo sapiens
agtgcgtgcgtccagcggaagtgctcccccggcgcggtccgccaggccagtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttacttgtggtcccagctactcaggaagctgaggtcagaggatcacctgaacctgggaagcagaggttgcagtgaactgagatcacgccactgtactggctgacaaagtgagacccctgtctaaaaaaaagataaagagagttacctgaatctggaatccttaatcttgggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccatagaatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccacca

SEQ ID NO: 52014 - DNA, 3472 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttacttgtggtcccagctactcaggaagctgaggtcagaggatcacctgaacctgggaagcagaggttgcagtgaactgagatcacgccactgtactggctgacaaagtgagacccctgtctaaaaaaaagataaagagagttacctgaatctggaatccttaatcttgggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccatagaatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccaccactgaaatggtatcttattacagtgaatgatggataatctgaaattactatagaaaaaaataaacccagaccattttgcctagagcctttcaacca
